United States Patent
Del'Guidice et al.

(10) Patent No.: US 11,629,170 B2
(45) Date of Patent: *Apr. 18, 2023

(54) RATIONALLY-DESIGNED SYNTHETIC PEPTIDE SHUTTLE AGENTS FOR DELIVERING POLYPEPTIDE CARGOS FROM AN EXTRACELLULAR SPACE TO THE CYTOSOL AND/OR NUCLEUS OF A TARGET EUKARYOTIC CELL, USES THEREOF, METHODS AND KITS RELATING TO SAME

(71) Applicant: FELDAN BIO INC., Québec (CA)

(72) Inventors: Thomas Del'Guidice, Québec (CA); Jean-Pascal Lepetit-Stoffaes, Québec (CA); David Guay, Québec (CA)

(73) Assignee: FELDAN BIO INC., Québec (CA)

( * ) Notice: Subject to any disclaimer, the term of this patent is extended or adjusted under 35 U.S.C. 154(b) by 455 days.

This patent is subject to a terminal disclaimer.

(21) Appl. No.: 16/341,681

(22) PCT Filed: Oct. 11, 2017

(86) PCT No.: PCT/CA2017/051205
§ 371 (c)(1),
(2) Date: Apr. 12, 2019

(87) PCT Pub. No.: WO2018/068135
PCT Pub. Date: Apr. 19, 2018

(65) Prior Publication Data
US 2020/0270307 A1    Aug. 27, 2020

Related U.S. Application Data

(63) Continuation of application No. 15/666,139, filed on Aug. 1, 2017, now Pat. No. 9,982,267.

(60) Provisional application No. 62/407,232, filed on Oct. 12, 2016, provisional application No. 62/535,015, filed on Jul. 20, 2017.

(51) Int. Cl.
| | | |
|---|---|---|
| *C07K 7/08* | (2006.01) | |
| *C07K 14/00* | (2006.01) | |
| *C12N 15/62* | (2006.01) | |
| *C12N 15/11* | (2006.01) | |
| *C12N 15/90* | (2006.01) | |
| *C12N 15/87* | (2006.01) | |
| *C12N 9/22* | (2006.01) | |
| *C12Q 1/68* | (2018.01) | |
| *A61K 38/00* | (2006.01) | |

(52) U.S. Cl.
CPC .............. *C07K 7/08* (2013.01); *C07K 14/00* (2013.01); *C12N 9/22* (2013.01); *C12N 15/11* (2013.01); *C12N 15/90* (2013.01); *A61K 38/00* (2013.01); *C07K 2319/02* (2013.01); *C07K 2319/09* (2013.01); *C07K 2319/10* (2013.01); *C12N 2310/20* (2017.05)

(58) Field of Classification Search
None
See application file for complete search history.

(56) References Cited

U.S. PATENT DOCUMENTS

| | | | |
|---|---|---|---|
| 7,579,318 B2 | 8/2009 | Divita et al. | |
| 8,242,081 B2 | 8/2012 | Divita et al. | |
| 9,738,687 B2 | 8/2017 | Guay et al. | |
| 9,982,267 B2 | 5/2018 | Del Guidice | |
| 2015/0071903 A1* | 3/2015 | Liu ..................... | C07K 14/463 424/94.3 |
| 2016/0298078 A1 | 10/2016 | Guay et al. | |
| 2018/0100158 A1 | 4/2018 | Del'Guidice et al. | |
| 2020/0181202 A1 | 6/2020 | Guay et al. | |

FOREIGN PATENT DOCUMENTS

| | | |
|---|---|---|
| WO | WO-2015038662 A1 | 3/2015 |
| WO | WO-2015089462 A1 | 6/2015 |
| WO | WO-2016161516 A1 | 10/2016 |
| WO | WO-2017049407 A1 | 3/2017 |

(Continued)

OTHER PUBLICATIONS

Keller, A-A., et al. 2014 Journal of Cellular Biochemistry 115: 243-252. (Year: 2014).*
Deshayes, S., et al. 2010 Biochimica et Biophysica Acta 1798: 2304-2314. (Year: 2010).*
Iwasaki, T., et al. 2015 Journal of Controlled Release 210: 115-124. (Year: 2015).*
Aguila, et al., (2011). SALL4 is a robust stimulator for the expansion of hematopoietic stem cells. Blood 118(3): 576-585.

(Continued)

*Primary Examiner* — Marsha Tsay
(74) *Attorney, Agent, or Firm* — Wilson Sonsini Goodrich & Rosati

(57) ABSTRACT

The present description relates to methods for delivering polypeptide cargos from an extracellular space to the cytosol and/or nucleus of a target eukaryotic cell. The methods involve contacting the cell with the polypeptide cargo in the presence of a peptide shuttle agent at a concentration sufficient to increase the polypeptide cargo's transduction efficiency. Also described here are parameters that may be used in the rational design of such synthetic peptide shuttle agents, peptide shuttle agents that satisfy one or more of these design parameters, as well as methods and compositions relating to the use of the synthetic peptide shuttle agents for delivery of a variety of polypeptide cargos (such as transcription factors, antibodies, CRISPR-associated nucleases and functional genome editing complexes) from an extracellular space to the cytosol and/or nucleus of target eukaryotic cells. Applications and targets for genome-editing NK cells for improved immunotherapy are also described.

17 Claims, 58 Drawing Sheets
Specification includes a Sequence Listing.

(56) References Cited

FOREIGN PATENT DOCUMENTS

| WO | WO-2017175072 A1 | 10/2017 |
| WO | WO-2018053632 A1 | 3/2018 |
| WO | WO-2018068135 A1 | 4/2018 |

OTHER PUBLICATIONS

Akinci, et al. (2012). Reprogramming of pancreatic exocrine cells towards a beta (beta) cell character using Pdx1, Ngn3 and MafA. Biochem J, 442(3): 539-550.
Alford et al., (2009).Toxicity of organic fluorophores used in molecular imaging: literature review. Mol Imaging. 8(6):341-54.
Amand, et al., (2012) Functionalization with C-terminal cysteine enhances transfection efficiency of cell-penetrating peptides through dimer formation.Biochem Biophys Res Commun,418(3): 469-474.
Andreu, et al., (1992) Shortened cecropin A-melittin hybrids. Significant size reduction retains potent antibiotic activity. FEBS Letters, 296:190-194.
Aoukaty, A. & Tan, R. (2005). Role for glycogen synthase kinase-3 in NK cell cytotoxicity and X-linked lymphoproliferative disease. J Immunol 174:4551-8.
Bejarano, L. A. and C. Gonzalez (1999) Motif trap:A rapid method to clone motifs that can target proteins to defined subcellular localisations J Cell Sci, 112( Pt 23):4207-4211.
Bikard et al. Programmable repression and activation of bacterial gene expression using an engineered CRISPR-Cas system. Nucleic Acids Res. 41:7429-7437 (2013).
Boman, et al., (1989) Antibacterial and antimalarial properties of peptides that are cecropin-melittin hybrids. FEBS letters, 259:103-106.
Braud, et al., (1998). HLA-E binds to natural killer cell receptors CD94/NKG2A, B and C. Nature 391:795-9.
Brock et al.: Efficient cell delivery mediated by lipid-specific endosomal escape of supercharged branched peptides; Traffic; 19:421-435 (2018).
Buganim et al., (2014)The Developmental Potential of iPSCs Is Greatly Influenced by Reprogramming Factor Selection. Cell stem cell. 15: 295-309.
Burstein et al., (2017), New CRISPR-Cas systems from uncultivated microbes. Nature. 542(7640):237-241.
Chan, C. K. and D. A. Jans (1999) Enhancement of polylysine-mediated transferrinfection by nuclear localization sequences: polylysine does not function as a nuclear localization sequence. Hum Gene Ther.,10(10):1695-1702.
Chan, C. K. and D. A. Jans (2001) Enhancement of MSH receptor- and GAL4-mediated gene transfer by switching the nuclear import pathway. Gene Ther 8(2):166-171.
Chang et al.: Cellular Internalization of Fluorescent Proteins via Arginine-rich Intracellular Delivery Peptide in Plant Cells; Plant Cell Physiol.; 46(3):482-488 (2005).
Cong, et al. Multiplex genome engineering using CRISPR/Cas systems. Science. 339.6121 (Feb. 15, 2013): 819-23. doi: 10.1126/science.1231143. Epub Jan. 3, 2013.
Cooper, et al., (2001). The biology of human natural killer-cell subsets. Trends Immunol 22:633-640 (Abstract).
Cox et al. Therapeutic genome editing: prospects and challenges. Nat Med 21:121-131 (2015).
De Kruijf, et al., (2010). HLA-E and HLA-G expression in classical HLA class I-negative tumors is of prognostic value for clinical outcome of early breast cancer patients. J Immunol 185:7452-9.
Delconte, et al., CIS is a potent checkpoint in NK cell-mediated tumor immunity. Nat Immunol, Jul. 2016; 17(7):816-24.
Denman, et al., (2012). Membrane-bound IL-21 promotes sustained ex vivo proliferation of human natural killer cells. PLoS ONE 7:e30264.
Dolfini, et al., (2012). The short isoform of NF-YA belongs to the embryonic stem cell transcription factor circuitry. Stem Cells, 30(11): 2450-2459.
Drin, et al., (2003) Studies on the internalization mechanism of cationic cell-penetrating peptides. J Biol Chem,278(33): 31192-31201.
Eisenberg et al., (1982). The helical hydrophobic moment: a measure of the amphiphilicity of a helix. Nature 299:371-374. (Abstract only).
El-Andaloussi, et al., (2007). A novel cell-penetrating peptide, M918, for efficient delivery of proteins and peptide nucleic acids. Mol Ther, 15(10):1820-1826.
Elmquist, et al., (2001). VE-cadherin-derived cell-penetrating peptide, pVEC, with carrier functions. Exp Cell Res 269(2):237-244.
El-Sayed, et al., (2009) Delivery of macromolecules using arginine-rich cell-penetrating peptides: ways to overcome endosomal entrapment. AAPS J, 11(1):13-22.
Erazo-Oliveras, et al. Protein delivery into live cells by incubation with an endosomolytic agent. Nat. Methods 11, 861-867 (2014).
Fanara, et al., (2000). Quantitative analysis of nuclear localization signal (NLS)-importin alpha interaction through fluorescence depolarization. Evidence for auto-inhibitory regulation of NLS binding. J Biol Chem 275(28): 21218-21223.
Fasoli et al., (2014) Mechanistic insight into CM18-Tat11 peptide membrane-perturbing action by whole-cell patch-clamp recording. Molecules. 19(7):9228-39.
Fawell et al., (1994). Tat-mediated delivery of heterologous proteins into cells. Proc Natl Acad Sci U S A, 91(2): 664-668.
Fominaya, et al., (1998). A chimeric fusion protein containing transforming growth factor-alpha mediates gene transfer via binding to the EGF receptor. Gene Ther 5(4): 521-530.
Fominaya, J. and W. Wels (1996). Target cell-specific DNA transfer mediated by a chimeric multidomain protein. Novel non-viral gene delivery system. J Biol Chem 271(18): 10560-10568.
Fonoudi, et al., (2013). ISL1 protein transduction promotes cardiomyocyte differentiation from human embryonic stem cells. PLoS One 8(1): e55577.
Gao et al., (2016) DNA-guided genome editing using the Natronobacterium gregoryi Argonaute. Nature Biotechnology 34:768-773.
Giguère et al., (2015) Machine learning assisted design of highly active peptides for drug discovery. PLoS Comput Biol. 11(4):e1004074.
Gilbert et al., (2013) CRISPR-mediated modular RNA-guided regulation of transcription in eukaryotes. Cell 154:442-451.
Gilmore, T. D. and H. M. Temin (1988). v-rel oncoproteins in the nucleus and in the cytoplasm transform chicken spleen cells. J Virol 62(3): 703-714.
Glover, et al.,(2009). Multifunctional protein nanocarriers for targeted nuclear gene delivery in nondividing cells. FASEB J 23(9): 2996-3006.
Gomez-Cabrero et al., Use of transduction proteins to target trabecular meshwork cells: outflow modulation by profilin I. Molecular Vision, 11:1071-1082, 2005.
Gordon, et al., (2012). The transcription factors T-bet and Eomes control key checkpoints of natural killer cell maturation. Immunity. 36(1): 55-67.
Gottschalk, et al., (1996). A novel DNA-peptide complex for efficient gene transfer and expression in mammalian cells. Gene Ther 3(5):448-457.
Gould, et al., (1989). A conserved tripeptide sorts proteins to peroxisomes. J Cell Biol 108(5): 1657-1664.
Green et al. Autonomous functional domains of chemically synthesized human immunodeficiency virus tat trans-activator protein. Cell 55:1179-1188 (1988).
Grimes, et al., (1996). Endocytosis of activated TrkA: evidence that nerve growth factor induces formation of signaling endosomes. J Neurosci 16(24): 7950-7964.
Guo, et al., (2015). Predictive value of HLA-G and HLA-E in the prognosis of colorectal cancer patients. Cell Immunol 293:10-6.
Hallbrink, et al., (2001). Cargo delivery kinetics of cell-penetrating peptides. Biochim Biophys Acta 1515(2):101-109.
Herce, H. D. and A. E. Garcia (2007). Molecular dynamics simulations suggest a mechanism for translocation of the HIV-1 TAT peptide across lipid membranes. Proc Natl Acad Sci U S A, 104(52): 20805-20810.

(56) References Cited

OTHER PUBLICATIONS

Ho et al., (2001). Synthetic protein transduction domains: enhanced transduction potential in vivo.*Cancer Research*61: 474-477.

Horng, et al., (2007). NKG2D signaling is coupled to the interleukin 15 receptor signaling pathway. Nat Immunol 8:1345-52.

Hou et al.: Transdermal delivery of proteins mediated by non-covalently associated arginine-rich intracellular delivery peptides; Experimental Dermatology; 16:999-1006 (2007).

Shoya, et al., (1998). Two proline-rich nuclear localization signals in the amino- and carboxyl-terminal regions of the Borna disease virus phosphoprotein. J .Virol, 72(12): 9755-9762.

Hurt, et al., (1985). The first twelve amino acids (less than half of the pre-sequence) of an imported mitochondrial protein can direct mouse cytosolic dihydrofolate reductase into the yeast mitochondrial matrix. EMBO J, 4(8): 2061-2068.

Ichii, et al., (2004). Bcl6 acts as an amplifier for the generation and proliferative capacity of central memory CD8+ T cells. J Immunol 173(2): 883-891.

Irie, et al., (2000). Molecular cloning and characterization of Amida, a novel protein which interacts with a neuron-specific immediate early gene product arc, contains novel nuclear localization signals, and causes cell death in cultured cells. J Biol Chem 275(4): 2647-2653.

Ishigami, et al., (2015). Human leukocyte antigen (HLA)-E and HLA-F expression in gastric cancer. Anticancer Res 35:2279-85.

Kakudo, et al.,(2004). Transferrin-modified liposomes equipped with a pH-sensitive fusogenic peptide: an artificial viral-like delivery system. Biochemistry. 43(19): 5618-5628.

Karniely, S. and O. Pines (2005). Single translation—dual destination: mechanisms of dual protein targeting in eukaryotes. EMBO Rep 6(5): 420-425.

Kato, et al., (1992). Max: functional domains and interaction with c-Myc. Genes Dev. 6(1): 81-92.

Kichler et al., (2003). Histidine-rich amphipathic peptide antibiotics promote efficient delivery of DNA into mammalian cells. Proc Natl Acad Sci U S A, 100(4):1564-1568.

Kichler, et al., (2006). Cationic amphipathic histidine-rich peptides for gene delivery. Biochim Biophys Acta 1758(3): 301-307.

Kirwan, S. E. & Burshtyn, D. N. (2005). Killer cell Ig-like receptor-dependent signaling by Ig-like transcript 2 (ILT2/CD85j/LILRB1/LIR-1). J Immunol 175:5006-15.

Kleinschmidt, J. A. and A. Seiter (1988). Identification of domains involved in nuclear uptake and histone binding of protein N1 of Xenopus laevis. EMBO J, 7(6):1605-1614.

Kohler, et al., (2001). Adenoviral E1A protein nuclear import is preferentially mediated by importin alpha3 in vitro. Virology 289(2): 186-191.

Kwon et al., (2010) A truncated HGP peptide sequence that retains endosomolytic activity and improves gene delivery efficiencies.Mol Pharm., 7(4):1260-1265.

Lamiable et al., (2016). PEP-FOLD3: faster de novo structure prediction for linear peptides in solution and in complex. Nucleic Acids Res. 44(W1):W449-54.

Lanford, et al., (1986). Induction of nuclear transport with a synthetic peptide homologous to the SV40 T antigen transport signal. Cell 46(4): 575-582.

Lee et al., Delivery of macromolecules into live cells by simple co-incubation with a peptide. Chembiochem., 11 (3):325-330, 2010.

Levy, et al., (2008). Human leukocyte antigen-E protein is overexpressed in primary human colorectal cancer. Int J Oncol 32:633-41.

Li, et al., (2004). GALA: a designed synthetic pH-responsive amphipathic peptide with applications in drug and gene delivery. Adv Drug Deliv Rev, 56(7): 967-985.

Lin, et al., (2013). B lymphocyte-induced maturation protein 1 (BLIMP-1) attenuates autoimmune diabetes in NOD mice by suppressing Th1 and Th17 cells. Diabetologia 56(1):136-146.

Liou et al.: Protein transduction in human cells in enhanced by cell-penetrating peptides fused with an endosomolytic HA2 sequence; Peptides; 273-284 (2012).

Liu, et al., (2003). Systemic genetic transfer of p21WAF-1 and GM-CSF utilizing of a novel oligopeptide-based EGF receptor targeting polyplex. Cancer Gene Ther, 10(7): 529-539.

Liu, et al., (2014). E3 ubiquitin ligase Cbl-b in innate and adaptive immunity. Cell Cycle 13:1875-84.

Liu et al., Cell-penetrating peptide-mediated delivery of TALEN proteins via bioconjugation for genome engineering. PLoS ONE 9(1):e85755, 2014.

Liu et al.: Intracellular delivery of quantum dots mediated by a histidine- and arginine-rich HR9 cell-penetrating peptide through the direct membrane translocation mechanism; Biomaterials; 32:3520-3537 (2011).

Lo et al., An endosomolytic Tat peptide produced by incorporation of histidine and cysteine residues as a nonviral vector for DNA transfection. ScienceDirect, Biomaterials, 29:2408-2414, 2008.

Loeser, et al., (2007). Spontaneous tumor rejection by cbl-b-deficient CD8+ T cells. J Exp Med 204:879-91.

London, E. (1992). Diphtheria toxin: membrane interaction and membrane translocation. Biochim Biophys Acta 1113(1): 25-51.

Lord-Dufour et al., (2009) Evidence for transcriptional regulation of the glucose-6-phosphate transporter by HIF-1 alpha: Targeting G6PT with mumbaistatin analogs in hypoxic mesenchymal stromal cells. Stem cells, 27:489-497.

Lorieau, et al., (2010). The complete influenza hemagglutinin fusion domain adopts a tight helical hairpin arrangement at the lipid:water interface. Proc Natl Acad Sci U S A, 107(25): 11341-11346.

Lu, et al., (2007). Recombinant HoxB4 fusion proteins enhance hematopoietic differentiation of human embryonic stem cells. Stem Cells Dev 16(4): 547-559.

Luan et al., (2015). Peptide amphiphiles with multifunctional fragments promoting cellular uptake and endosomal escape as efficient gene vectors.*J. Mater. Chem.* B, 3: 1068-1078.

Lutz-Nicoladoni, et al., (2015). Modulation of Immune Cell Functions by the E3 Ligase Cbl-b. Front Oncol 5:58.

Mack, et al., (1998). Aminooxypentane-RANTES induces CCR5 internalization but inhibits recycling: a novel inhibitory mechanism of HIV infectivity. J Exp Med, 187(8):1215-1224.

Maeng, et al., (2013). Effects of single nucleotide polymorphisms on treatment outcomes and toxicity in patients treated with sunitinib. Anticancer Res 33(10): 4619-4626.

Mahlum, et al., (2007). Engineering a noncarrier to a highly efficient carrier peptide for noncovalently delivering biologically active proteins into human cells. Anal Biochem. 365(2):215-221.

Makarova et al., (2011) Unification of Cas protein families and a simple scenario for the origin and evolution of CRISPR-Cas systems. Biol Direct. 6:38.

Makkerh, et al., (1996). Comparative mutagenesis of nuclear localization signals reveals the importance of neutral and acidic amino acids. Curr Biol. 6(8): 1025-1027.

Martinez-Fong, et al., (1999). Neurotensin-SPDP-poly-L-lysine conjugate: a nonviral vector for targeted gene delivery to neural cells. Brain Res Mol Brain Res. 69(2): 249-262.

Matalon, et al., (2016). Dephosphorylation of the adaptor LAT and phospholipase C-gamma by SHP-1 inhibits natural killer cell cytotoxicity. Sci Signal 9:ra54.

Maurer, M. and E. von Stebut (2004). Macrophage inflammatory protein-1. Int J Biochem Cell Biol. 36(10): 1882-1886.

McKay, et al., (2002). Secretin-mediated gene delivery, a specific targeting mechanism with potential for treatment of biliary and pancreatic disease in cystic fibrosis. Mol Ther 5(4): 447-454.

Midoux, et al., (1998). Membrane permeabilization and efficient gene transfer by a peptide containing several histidines. Bioconjug Chem.9(2):260-267.

Milenkovic, et al., (2009). Identification of the signal directing Tim9 and Tim10 into the intermembrane space of mitochondria. Mol Biol Cell 20(10): 2530-2539.

Moede, et al., (1999). Identification of a nuclear localization signal, RRMKWKK, in the homeodomain transcription factor PDX-1. FEBS Lett 461(3): 229-234.

Montrose, et al., (2013). Xentry, a new class of cell-penetrating peptide uniquely equipped for delivery of drugs. Sci Rep 3: 1661.

(56) References Cited

OTHER PUBLICATIONS

Moreland, et al., (1987). Amino acid sequences that determine the nuclear localization of yeast histone 2B. Mol Cell Biol 7(11): 4048-4057.
Morris, et al., (2001). A peptide carrier for the delivery of biologically active proteins into mammalian cells. Nat Biotechnol 19(12): 1173-1176.
Morris, et al., (2004). Combination of a new generation of PNAs with a peptide-based carrier enables efficient targeting of cell cycle progression. Gene Ther 11 (9): 757-764.
Nagahara et al.: Transduction of full-length TAT fusion proteins into mammalian cells: TAT-p27Kip1 induces cell migration; Nature Medicine; 4(12):1449-1452 (1998).
Nakanishi, et al., (2002). Interaction of the Vp3 nuclear localization signal with the importin alpha 2/beta heterodimer directs nuclear entry of infecting simian virus 40. J Virol, 76(18): 9368-9377.
O'Keefe, D. O. (1992). Characterization of a full-length, active-site mutant of diphtheria toxin. Arch Biochem Biophys 296(2): 678-684.
Paolino, et al., (2014). The E3 ligase Cbl-b and TAM receptors regulate cancer metastasis via natural killer cells. Nature 507:508-12.
Parameswaran, et al., (2016). Repression of GSK3 restores NK cell cytotoxicity in AML patients. Nat Commun 7:11154.
Parente, et al., (1990). Mechanism of leakage of phospholipid vesicle contents induced by the peptide GALA. Biochemistry, 29(37): 8720-8728.
Patel, P. & Woodgett, J. R. (2017). Glycogen Synthase Kinase 3: A Kinase for All Pathways? Curr Top Dev Biol 123:277-302.
Paul, et al., (1997). Gene transfer using a novel fusion protein, GAL4/invasin.Hum Gene Ther,8(10): 1253-1262.
PCT/IB2017/000512 International Preliminary Report on Patentability and Written Opinion dated Oct. 9, 2018.
PCT/IB2017/000512 International Search Report and Written Opinion dated Jul. 26, 2017.
Perez, et al., (1992). Antennapedia homeobox as a signal for the cellular internalization and nuclear addressing of a small exogenous peptide. J Cell Sci 102 (Pt 4): 717-722.
Pimenta, et al., (2000). Alpha1-antichymotrypsin and kallistatin hydrolysis by human cathepsin D.J Protein Chem, 19(5): 411-418.
Poli, et al., (2009). CD56bright natural killer (NK) cells: an important NK cell subset. Immunology 126:458-65.
Prieve, M. G. and M. L. Waterman (1999). Nuclear localization and formation of beta-catenin-lymphoid enhancer factor 1 complexes are not sufficient for activation of gene expression. Mol Cell Biol, 19(6): 4503-4515.
Rajagopalan, et al., (2007). Recombinant fusion proteins TAT-Mu, Mu and Mu-Mu mediate efficient non-viral gene delivery. J Gene Med, 9(4): 275-286.
Ramakrishna et al., (2014) Gene disruption by cell-penetrating peptide-mediated delivery of Cas9 protein and guide RNA. Genome Research, 24:1020-1027.
Riddell et al., (2014) Reprogramming committed murine blood cells to induced hematopoietic stem cells with defined factors. Cell, 157: 549-564.
Salomone, et al., (2012). A novel chimeric cell-penetrating peptide with membrane-disruptive properties for efficient endosomal escape. J Control Release, 163(3): 293-303.
Salomone et al., (2013) In vitro efficient transfection by CM18-Tat11 hybrid peptide: a new tool for gene-delivery applications. PLoS One 8(7):e70108, 11 pages.
Salomone et al., High-Yield nontoxic gene transfer through conjugation of the CM18-Tat11 chimeric peptide with nanosecond electric pulses. Molecular Pharmaceutics, 9 pages, 2014, available at: http://pubs.acs.org.
Schneider, et al., (1998).A novel peptide, PLAEIDGIELTY, for the targeting of alpha9beta1-integrins.FEBS Lett, 429(3): 269-273.
Schreiber, et al., (1992). The human poly(ADP-ribose) polymerase nuclear localization signal is a bipartite element functionally separate from DNA binding and catalytic activity. EMBO J, 11(9): 3263-3269.

Schuster, et al., (1999). Multicomponent DNA carrier with a vesicular stomatitis virus G-peptide greatly enhances liver-targeted gene expression in mice. Bioconjug Chem, 10(6):1075-1083.
Scott, et al., (2010).Characterization and prediction of protein nucleolar localization sequences. Nucleic Acids Res, 38(21): 7388-7399.
Shaw, et al., (2008). Comparison of protein transduction domains in mediating cell delivery of a secreted CRE protein. Biochemistry, 47(4):1157-1166.
Shawe-Taylor and Cristianini (2004) Kernel methods for pattern analysis. Cambridge University Press, 12 pages.
Shen et al., (2014) Improved PEP-FOLD approach for peptide and miniprotein structure prediction. J. Chem. Theor. Comput. 10:4745-4758.
Somasekaram, et al., (1999). Intracellular localization of human cytidine deaminase. Identification of a functional nuclear localization signal. J Biol Chem. 274(40): 28405-28412.
Stojanovski, et al., (2012). Mechanisms of protein sorting in mitochondria. Cold Spring Harbor Perspect Biol, 4(10):a011320, 18 pages.
Sudbeck, P. and G. Scherer (1997). Two independent nuclear localization signals are present in the DNA-binding high-mobility group domains of SRY and SOX9. J Biol Chem ., 272(44): 27848-27852.
Sung, et al., (2013).Efficient myogenic differentiation of human adipose-derived stem cells by the transduction of engineered MyoD protein. Biochem Biophys Res Commun, 437(1):156-161.
Takahashi, K. and S. Yamanaka (2006). Induction of pluripotent stem cells from mouse embryonic and adult fibroblast cultures by defined factors. Cell 126(4): 663-676.
Takeda, et al., (2006). NUP98-HOXA9 induces long-term proliferation and blocks differentiation of primary human CD34+ hematopoietic cells. Cancer Res., 66(13): 6628-6637.
Tan, et al., (2010). Increased levels of FoxA1 transcription factor in pluripotent P19 embryonal carcinoma cells stimulate neural differentiation. Stem Cells Dev., 19(9):1365-1374.
Tan, et al., (2012). Truncated peptides from melittin and its analog with high lytic activity at endosomal pH enhance branched polyethylenimine-mediated gene transfection. J Gene Med 14(4): 241-250.
Thévenet et al., (2012) PEP-FOLD: an updated de novo structure prediction server for both linear and disulfide bonded cyclic peptides. Nucleic Acids Res. 40:W288-293.
Uherek, et al., (1998). A modular DNA carrier protein based on the structure of diphtheria toxin mediates target cell-specific gene delivery. J Biol Chem 273(15): 8835-8841.
U.S. Appl. No. 15/094,365 Applicant Initiated Interview Summary dated Jan. 11, 2017.
U.S. Appl. No. 15/094,365 Office Action dated Dec. 15, 2016.
U.S. Appl. No. 15/094,365 Restriction Requirement dated Aug. 2, 2016.
U.S. Appl. No. 15/486,155 Final Office Action dated Feb. 4, 2019.
U.S. Appl. No. 15/486,155 Office Action dated Apr. 2, 2018.
U.S. Appl. No. 15/486,155 Office Action dated May 24, 2019.
U.S. Appl. No. 15/666,139 First Action Interview Office Action dated Feb. 2, 2018.
Varkouhi, et al., (2011). Endosomal escape pathways for delivery of biologicals. J Control Release 151(3): 220-228.
Veach, et al., (2004). Receptor/transporter-independent targeting of functional peptides across the plasma membrane. J Biol Chem., 279(12):11425-11431.
Vives, et al., (1997). A truncated HIV-1 Tat protein basic domain rapidly translocates through the plasma membrane and accumulates in the cell nucleus. J Biol Chem., 272(25): 16010-16017.
Wagstaff, et al., (2007). Histone-mediated transduction as an efficient means for gene delivery. Mol Ther., 15(4): 721-731.
Warr, et al., (2013). FOXO3A directs a protective autophagy program in haematopoietic stem cells. Nature 494(7437): 323-327.
Welch, et al., (1999). RanBP3 contains an unusual nuclear localization signal that is imported preferentially by importin-alpha3. Mol Cell Biol. 19(12):8400-8411.

(56) References Cited

OTHER PUBLICATIONS

Wiedenheft et al. RNA-guided complex from a bacterial immune system enhances target recognition through seed sequence interactions. PNAS USA 108:10092-10097 (2011).
Witzel, et al., (2013). Androgen receptor expression is a predictive marker in chemotherapy-treated patients with endocrine receptor-positive primary breast cancers. J Cancer Res Clin Oncol., 139(5): 809-816.
Wu, et al., (2015). Rescuing lymphocytes from HLA-G immunosuppressive effects mediated by the tumor microenvironment. Oncotarget 6:37385-97.
Wu, et al., (1999). The quaking I-5 protein (QKI-5) has a novel nuclear localization signal and shuttles between the nucleus and the cytoplasm. J Biol Chem., 274(41): 29202-29210.
Wyman, et al., (1997). Design, synthesis, and characterization of a cationic peptide that binds to nucleic acids and permeabilizes bilayers. Biochemistry, 36(10): 3008-3017.
Ye, et al., (2007). Human leukocyte antigen G expression: as a significant prognostic indicator for patients with colorectal cancer. Mod Pathol 20:375-83.
Yie, et al., (2007). Expression of HLA-G is associated with prognosis in esophageal squamous cell carcinoma. Am J Clin Pathol 128:1002-1009.
Yie, et al., (2007). Expression of human leucocyte antigen G (HLA-G) is associated with prognosis in non-small cell lung cancer. Lung Cancer 58:267-74.
Yie, et al., (2007). Expression of human leukocyte antigen G (HLA-G) correlates with poor prognosis in gastric carcinoma. Ann Surg Oncol 14: 2721-2729.
Yu, et al., (1998). A constitutive nuclear localization signal from the second zinc-finger of orphan nuclear receptor TR2. J Endocrinol., 159(1):53-60.
Zetsche et al., (2015). Cpf1 Is a Single RNA-Guided Endonuclease of a Class 2 CRISPR-Cas System. Cell. 25. pii: S0092-8674(15)01200-3[http://dx.doi.org/10.1016/j.cell.2015.09.038].
Zhen, et al., (2013). Impact of HLA-E gene polymorphism on HLA-E expression in tumor cells and prognosis in patients with stage III colorectal cancer. Med Oncol 30:482.
Zhou et al. Generation of induced pluripotent stem cells using recombinant proteins. Cell Stem Cell 4(5):381-384 (2009).
Barrangou, R. and Luciano A. Marraffini (2014). CRISPR-Cas Systems: Prokaryotes Upgrade to Adaptive Immunity. Mod. Cell 54(2):234-244.
Miyoshi, et al., (1994). "[Structure and regulation of human thyroid-stimulating hormone (TSH) gene]." Nihon Rinsho 52(4):940-947.
U.S. Appl. No. 15/486,155 Final Office Action dated Sep. 25, 2019.
Crombez et al.: A New Potent Secondary Amphipathic Cell-penetrating Peptide for siRNA Delivery Into Mammalian Cells. Molecular Therapy. 17(1): 95-103 (2009).
Del'Guidice et al.: Intrabody Delivery—The Feldan Shuttle Technology: A Peptide-Based Method to Deliver Antibodies. Drug Development & Delivery. 18(1):28-32 (2018).
Del'Guidice et al.: Membrane permeabilizing amphiphilic peptide delivers recombinant transcription factor and CRISPR-Cas9/Cpf1 ribonucleoproteins in hard-to-modify cells. PLOS One 13(4):e0195558. doi: 10.1371/journal.pone.0195558 (2018).
Ebina et al.: Transcription factor-mediated reprogramming toward hematopoietic stem cells. EMBO Journal. 34(6):694-709 (2015).
Erazo-Oliveras et al.: Improving the endosomal escape of cell-penetrating peptides and their cargos: strategies and challenges. Pharmaceuticals. 5(11):1177-1209 (2012).
Farkhani et al.: Cell penetrating peptides: efficient vectors for delivery of nanoparticles, nanocarriers, therapeutic and diagnostic molecules. Peptides. 57:78-94 (2014).
Firas et al.: Transcription factor-mediated reprogramming: epigenetics and therapeutic potential. Immunology and Cell Biology. 93(3):284-289 (2015).
Ford et al.: Protein transduction: an alternative to genetic intervention? Gene Ther. 8(1):1-4 (2001).

Fujita et al.: Applications of Engineered DNA-Binding Molecules Such as TAL Proteins and the CRISPR/Cas System in Biology Research. International Journal of Molecular Sciences. 16(10):23143-23164 (2015).
Hsu et al.: Development and applications of CRISPR-Cas9 for genome engineering. Cell 157(6):1262-1278 (2014).
Ilfeld et al.: The End of Postoperative Pain—A Fast-Approaching Possibility? And, if So, Will We Be Ready? Regional Anesthesia and Pain Medicine 34(2):85-87 (2009).
Jinek et al.: Bacterial Immunity A Programmable Dual-RNA-Guided DNA Endonuclease in Adaptive. Science. 337(6096):816-821 (2012).
Kabouridis: Biological applications of protein transduction technology. Trends in Biotechnology. 21(11):498-503 (2003).
Kadkhodayan et al.: Generation of GFP Native Protein for Detection of Its Intracellular Uptake by Cell-Penetrating Peptides. Folia Biologica (Praha). 62, 103-109 (2016).
Keller et al.: Relationships between Cargo, Cell Penetrating Peptides and Cell Type for Uptake of Non-Covalent Complexes into Live Cells. Pharmaceuticals. 6: 184-203 (2013) doi:10.3390/ph6020184.
Krishnamurthy et al.: Engineered amphiphilic peptides enable delivery of proteins and CRISPR-associated nucleases to airway epithelia. Nature Communications. 0(1):4906. doi: 10.1038/S41467-019-12922-y (2019).
Kurzawa et al.: PEP and CADY-mediated delivery of fluorescent peptides and proteins into living cells. Biochimica et Biophysica Acta. 1798: 2274-2285 (2010).
Li et al.: Delivery of intracellular-acting biologies in pro-apoptotic therapies. Current Pharmaceutical Design. 17(3):293-319 (2011).
Lin et al.: HLA-G expression in human ovarian carcinoma counteracts NK cell function. Annals of Oncology. 18:1804-1809 (2007).
Morris et al.: A peptide carrier for the delivery of biologically active proteins into mammalian cells. Nat Biotechnol 19(12):1173-1176 (2001).
Mussbach et al.: Transduction of Peptides and Proteins Into Live Cells by Cell Penetrating Peptides. Journal of Cellular Biochemistry. 112: 3824-3833 (2011).
PCT/CA2020/050517 International Search Report and Written Opinion dated Jul. 17, 2020.
Ramsey et al.: Cell-Penetrating peptides transport therapeutics into cells. Pharmacology & Therapeutics. 154:78-86 (2015).
Regalado: Who owns the biggest biotech discover of the century?. MIT Technology Review. 4 pages (2014).
Sampson et al.: Exploiting CRISPR/Cas systems for biotechnology. Bioessays. 36(1):34-38 (2014).
Sato et al.: Peptide-membrane interactions and mechanisms of membrane destruction by amphipathic α-helical antimicrobial peptides. Biochimica et Biophysica Acta 1758:1245-1256 (2006).
Simeoni et al.: Insight into the mechanism of the peptide-based gene delivery system MPG: implications for delivery of siRNA into mammalian cells. Nucleic Acids Research, 31(11): 27170-2724 (2003).
Sun et al.: PTD4-apoptin protein therapy inhibits tumor growth in vivo. Int J cancer. 124(12):2973-2981 (2009).
Tansi et al.: Internalization of near-infrared fluorescently labeled activatable cell-penetrating peptide and of proteins into human fibrosarcoma cell line HT-1080. Journal of Cellular Biochemistry. (2015) doi: 10.1002/jcb.25075.
Thériault et al.: Differential modulation of Nav1.7 and Nav1.8 channels by antidepressant drugs. European Journal of Pharmacology. 764:395-403 (2015).
Wan: An Overall Comparison of Small Molecules and Large Biologies in ADME Testing. ADMET & DMPK 4(1):1-22; doi: 10.5599/admet.4.1.276 (2016).
Lee et al.: Activatable Cell Penetrating Peptide—Peptide Nucleic Acid Conjugate via Reduction of Azobenzene PEG Chains. J. Am. Chem. Soc. 136:12868-12871 (2014).
U.S. Appl. No. 62/474,827, filed Mar. 22, 2017.
Ain et al.: Effects of protein transduction domain (PTD) selection and position for improved intracellular delivery of PTD-Hsp27 fusion protein formulations. Arch. Pharm. Res. 39:1266-1274 (2016).

(56) References Cited

OTHER PUBLICATIONS

Cardarelli et al.: Quantitative Analysis of Tat Peptide Binding to Import Carriers Reveals Unconventional Nuclear Transport Properties. The Journal of Biological Chemistry. 286(14):12292-12299 (2011).
IL Patent Application No. IL265920 Office Action dated Jul. 25, 2022.

* cited by examiner

Fig. 23A  Fig. 23B  Fig. 23C  Fig. 23D
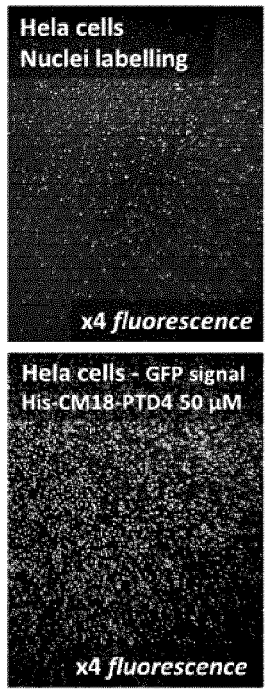
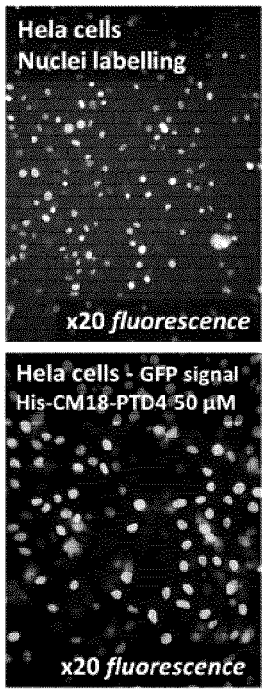
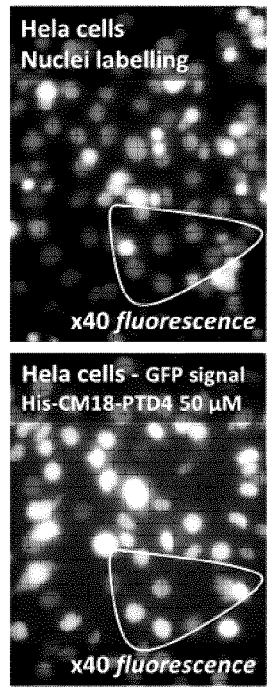
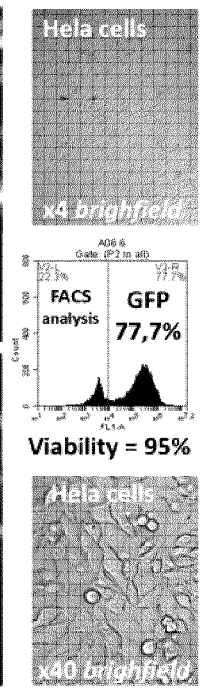
Fig. 24A  Fig. 24B
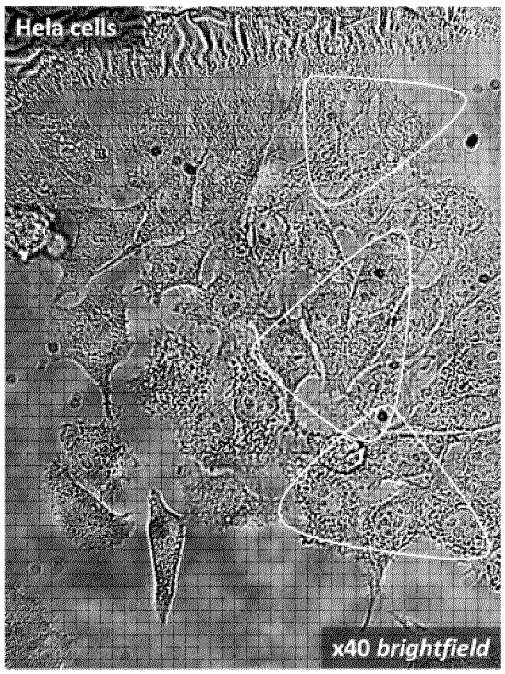
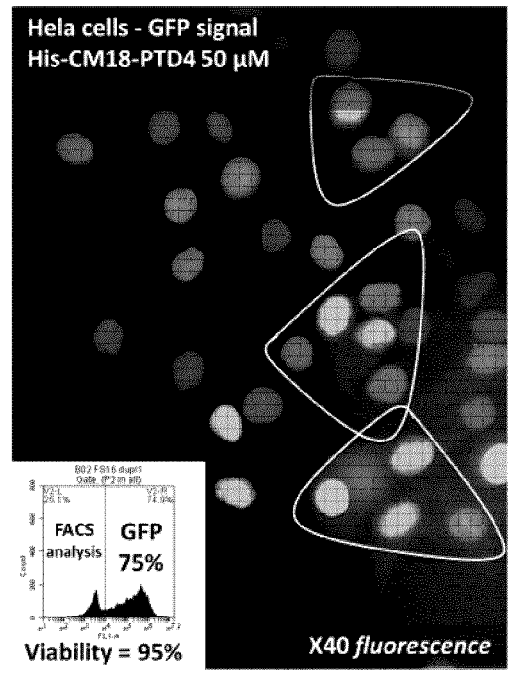

Fig. 25A
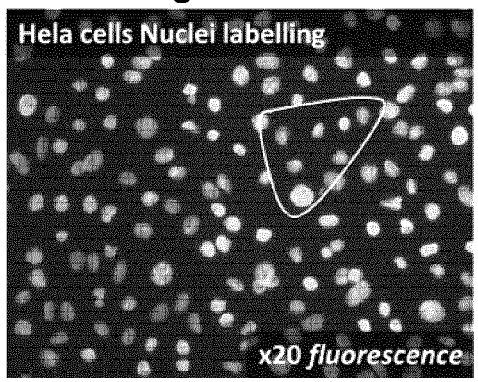
Fig. 25B
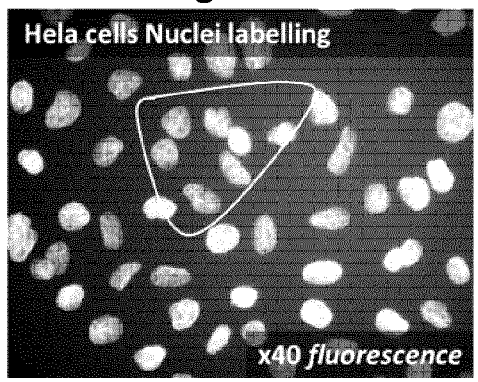
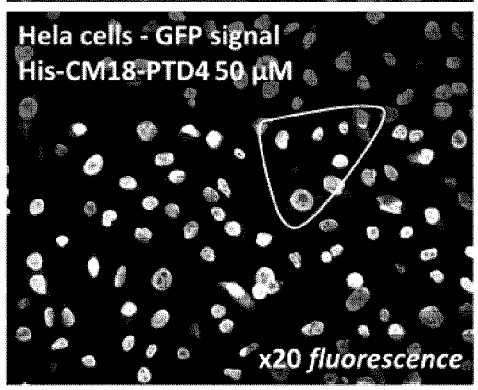
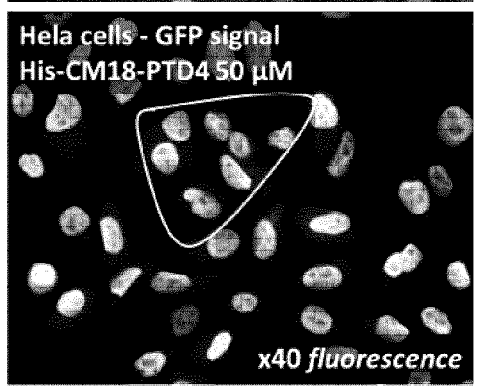
Fig. 26A
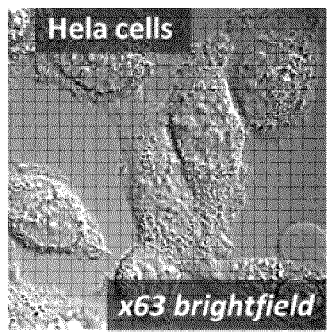
Fig. 26C
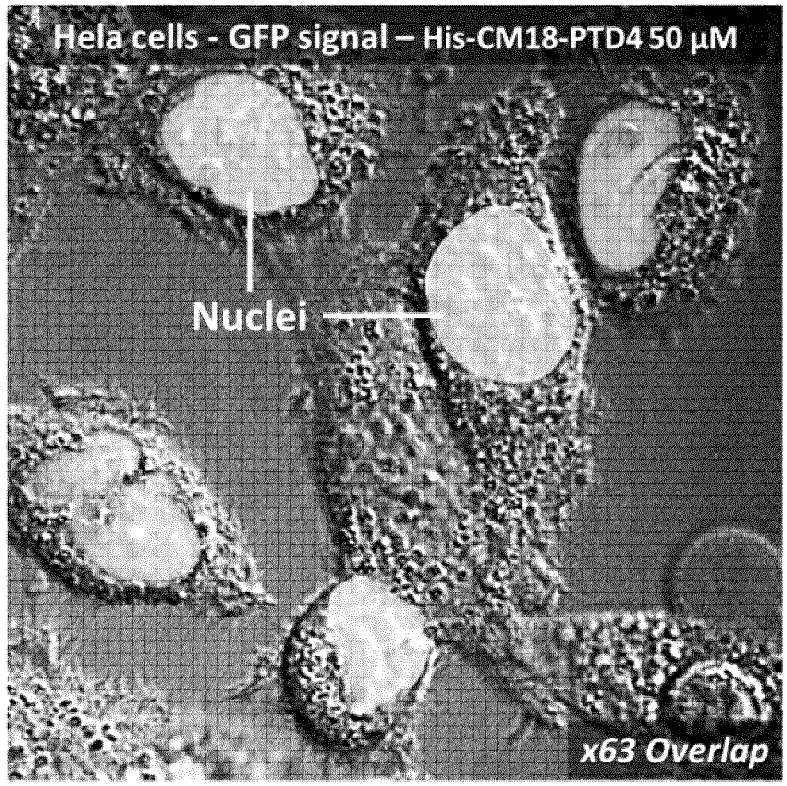
Fig. 26B
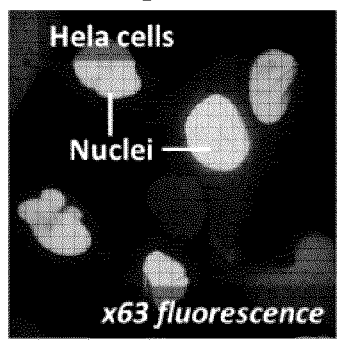

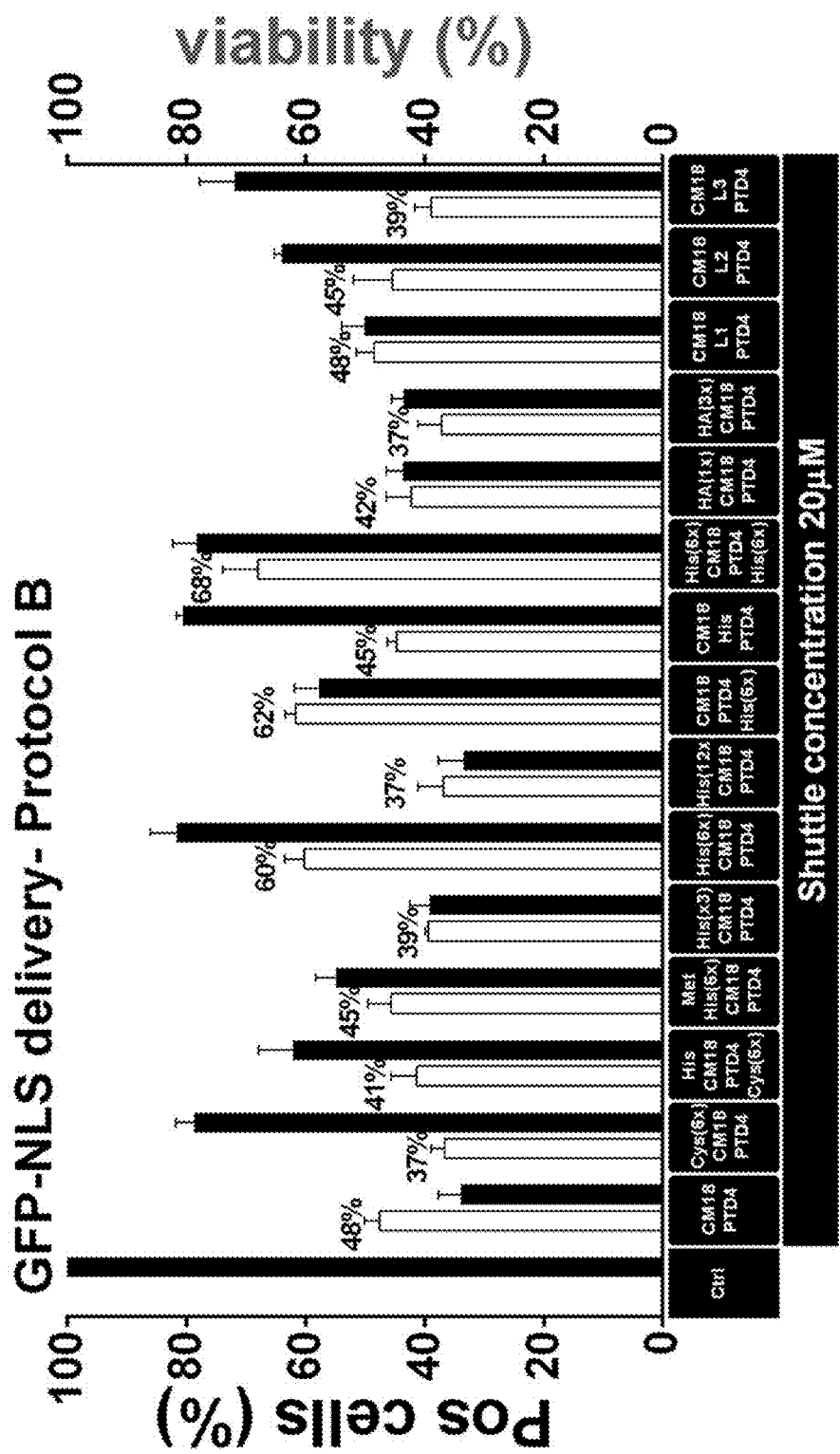

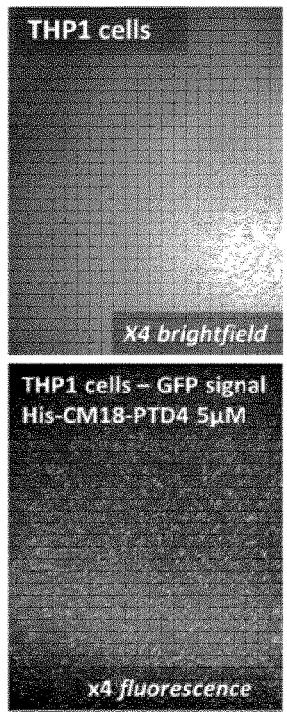
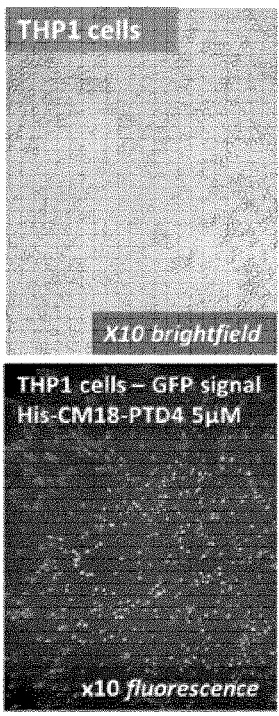
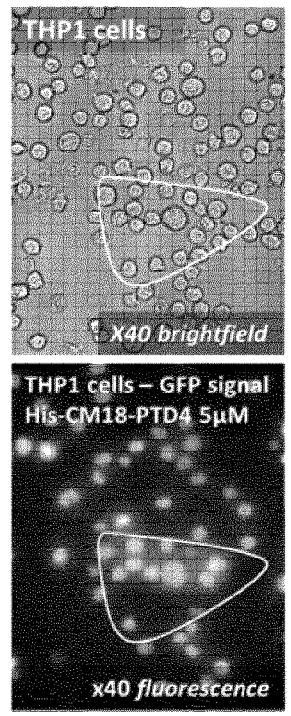
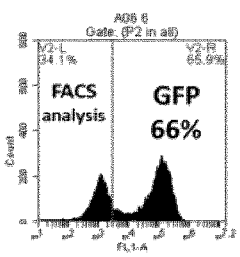
Fig. 32A    Fig. 32B    Fig. 32C    Fig. 32D
Viability = 95%
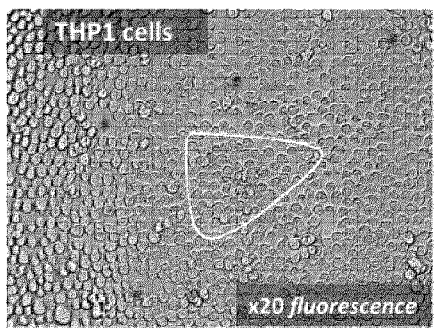
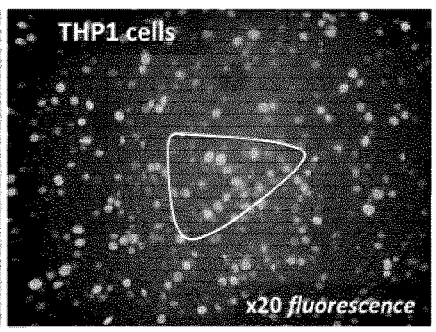
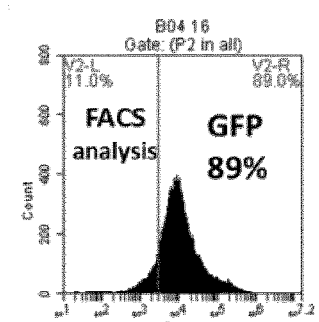
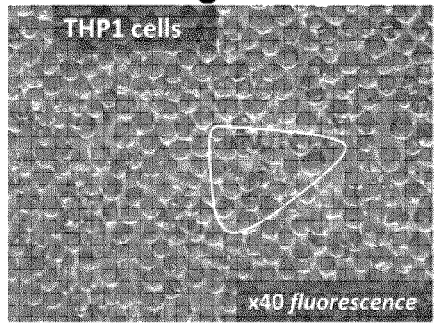
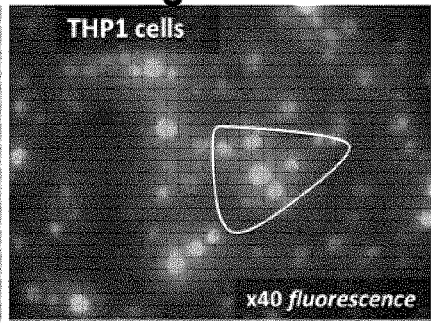
Fig. 33A    Fig. 33C
Fig. 33B    Fig. 33D
Viability = 75%

Fig. 36
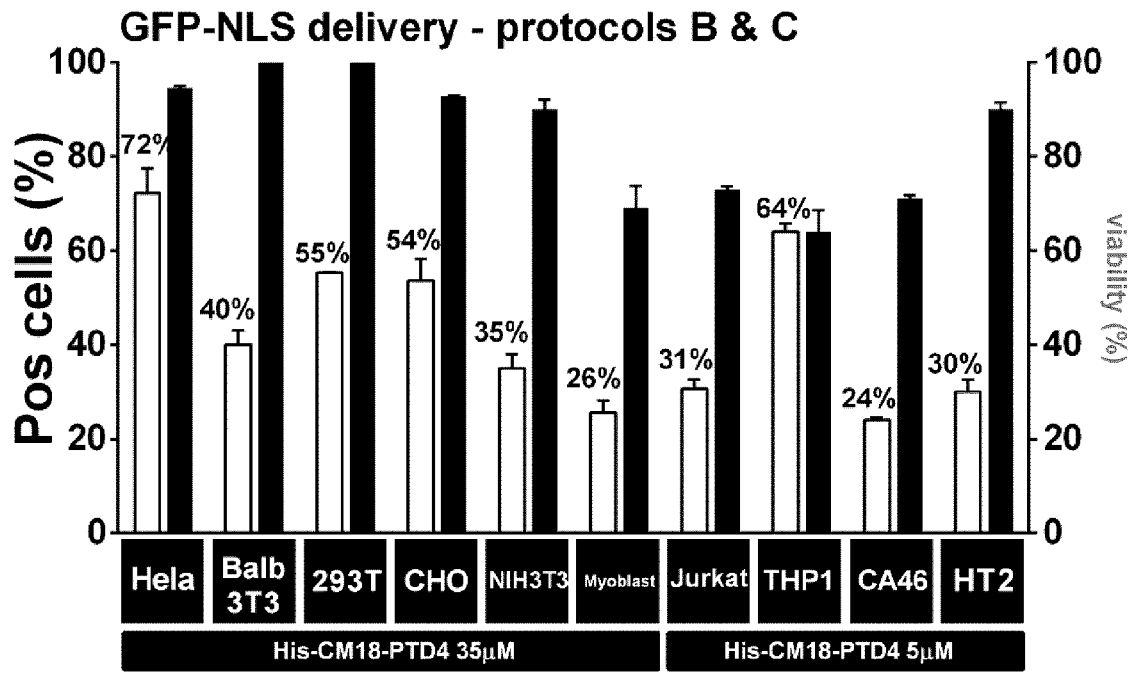
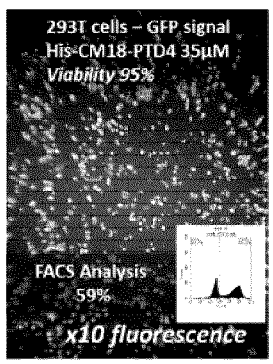
Fig. 37A
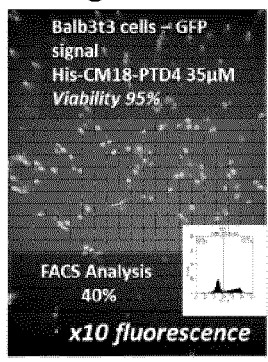
Fig. 37B
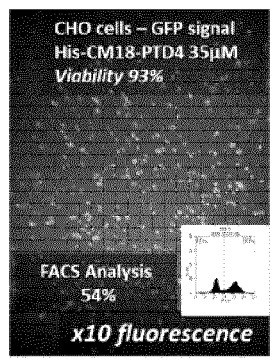
Fig. 37C
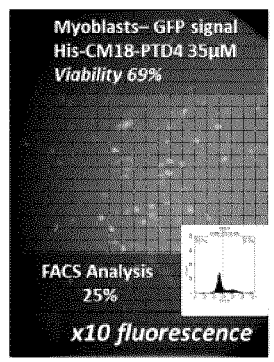
Fig. 37D
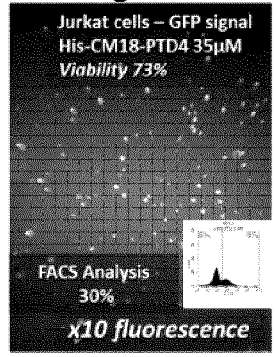
Fig. 37E
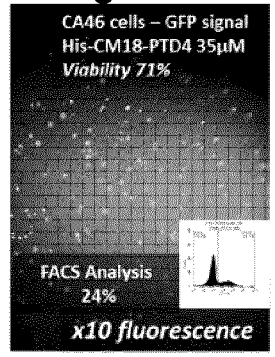
Fig. 37F
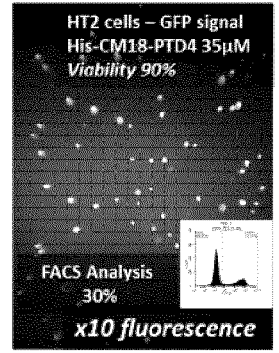
Fig. 37G
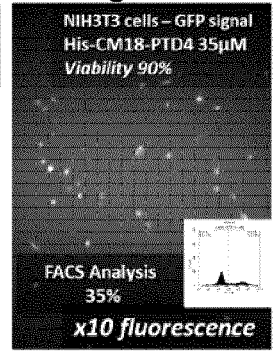
Fig. 37H A - No treatment
B - His-C(LLKK)3C-PTD4
C - Negative control
D - Positive control Fig. 49A
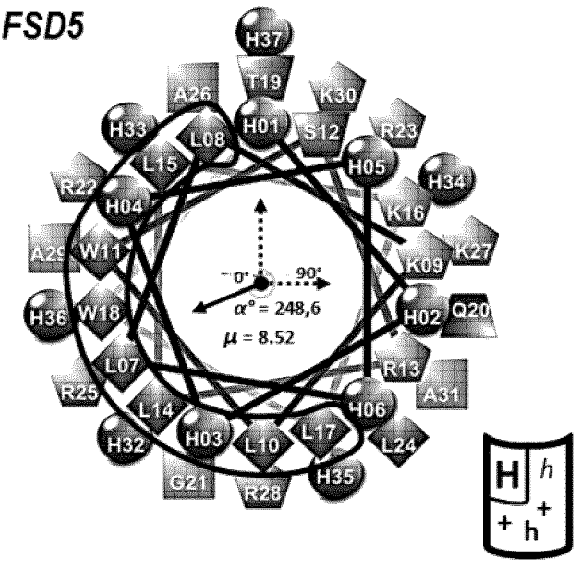
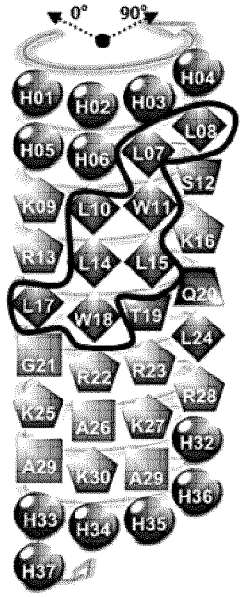
Fig. 49B
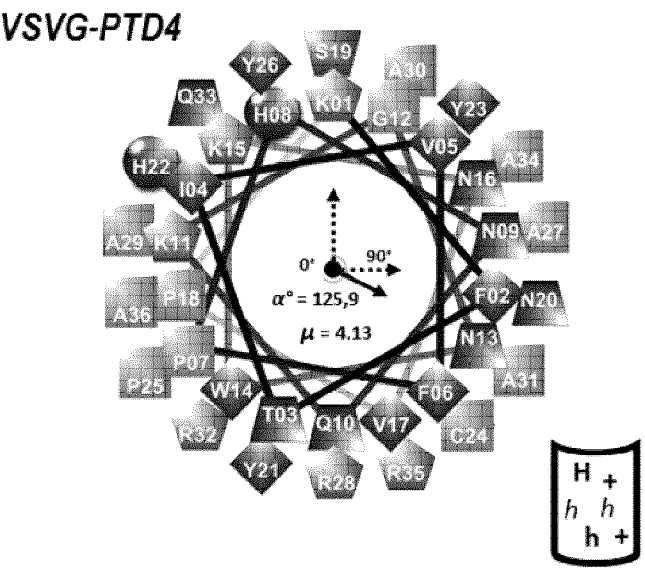
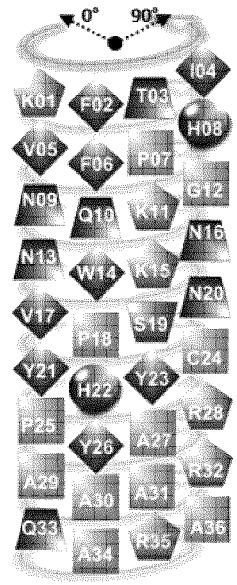
- Highly Hydrophobic a.a.
- Hydrophobic a.a.
- Positively charged a.a.
- Highly hydrophilic a.a.
- Low hydrophilic a.a.
- Histidine residues

FSD5

FSD18

VSVG-PTD4

FSN7

| Position | 1 | | | | | | | 10 | | | | | | | | | 20 | | | | | | | | | 30 | | | | | | | | | | | | | | | SEQ ID NO: |
|---|---|---|---|---|---|---|---|---|---|---|---|---|---|---|---|---|---|---|---|---|---|---|---|---|---|---|---|---|---|---|---|---|---|---|---|---|---|---|---|---|---|
| His-CM18-PTD4 | K | W | K | L | F | K | K | I | G | A | - | V | L | K | V | L | T | T | G | - | - | - | - | - | - | Y | A | R | A | A | A | R | Q | A | R | A | - | 90 |
| FSD10 | K | W | K | L | A | R | A | F | A | R | - | A | I | K | K | L | - | - | - | - | - | - | - | - | - | Y | A | R | A | L | R | R | Q | A | R | T | G | 113 |
| EB1-PTD4 | - | - | L | I | R | L | W | S | H | - | L | I | H | I | W | F | Q | N | R | R | L | K | W | K | K | K | Y | A | R | A | A | A | R | Q | A | R | A | 88 |
| FSD5 | - | - | L | L | K | L | W | S | R | - | L | L | K | L | W | T | Q | G | R | R | L | - | - | - | - | K | A | K | R | A | K | A | - | - | - | - | - | 108 |
| FSD19 | - | - | L | L | K | L | W | S | R | - | L | L | K | T | W | T | Q | G | R | R | L | - | - | - | - | K | A | K | S | A | Q | A | S | T | R | Q | A | 122 |
| FSD20 | - | A | A | V | L | K | L | W | K | R | - | L | L | K | L | F | R | K | G | R | R | L | - | - | - | K | A | K | R | A | K | A | K | R | - | - | - | 123 |
| FSD21 | - | - | F | L | K | I | W | S | R | - | L | I | K | I | W | T | Q | G | R | R | - | - | - | - | - | K | G | A | Q | A | A | F | R | - | - | - | - | 124 |
| FSD44 | - | - | I | L | K | I | W | S | R | - | L | I | K | I | W | T | Q | G | R | R | - | - | - | - | - | K | G | A | Q | A | A | I | R | - | - | - | - | 170 |
| FSD46 | - | - | F | L | K | I | W | S | R | - | L | I | K | I | W | T | Q | G | L | R | - | - | - | - | - | K | G | A | Q | A | A | K | R | - | - | - | - | 172 |
| His-C(LLKK)3C-PTD4 | - | C | L | L | K | K | L | L | K | K | - | L | L | K | K | C | - | - | - | - | - | - | - | - | - | - | - | Y | A | R | A | A | A | R | Q | A | R | A | 72 |
| FSD63 | - | W | - | I | I | - | - | T | W | L | R | K | I | L | K | R | F | - | - | G | - | - | - | - | - | K | A | A | Q | S | G | F | R | I | A | R | - | 189 |
| Consistency | 0 | 0 | 0 | 7 | 4 | 7 | 5 | 6 | 5 | 7 | 0 | 8 | 7 | 8 | 8 | 4 | 5 | 3 | 3 | 5 | 2 | 3 | 1 | 0 | 0 | 10 | 5 | 3 | 10 | 7 | 9 | 4 | 3 | 6 | 12 | 1 | 0 | 0 |

Unconserved 0 1 2 3 4 5 6 7 8 9 10 Conserved

Fig. 49G

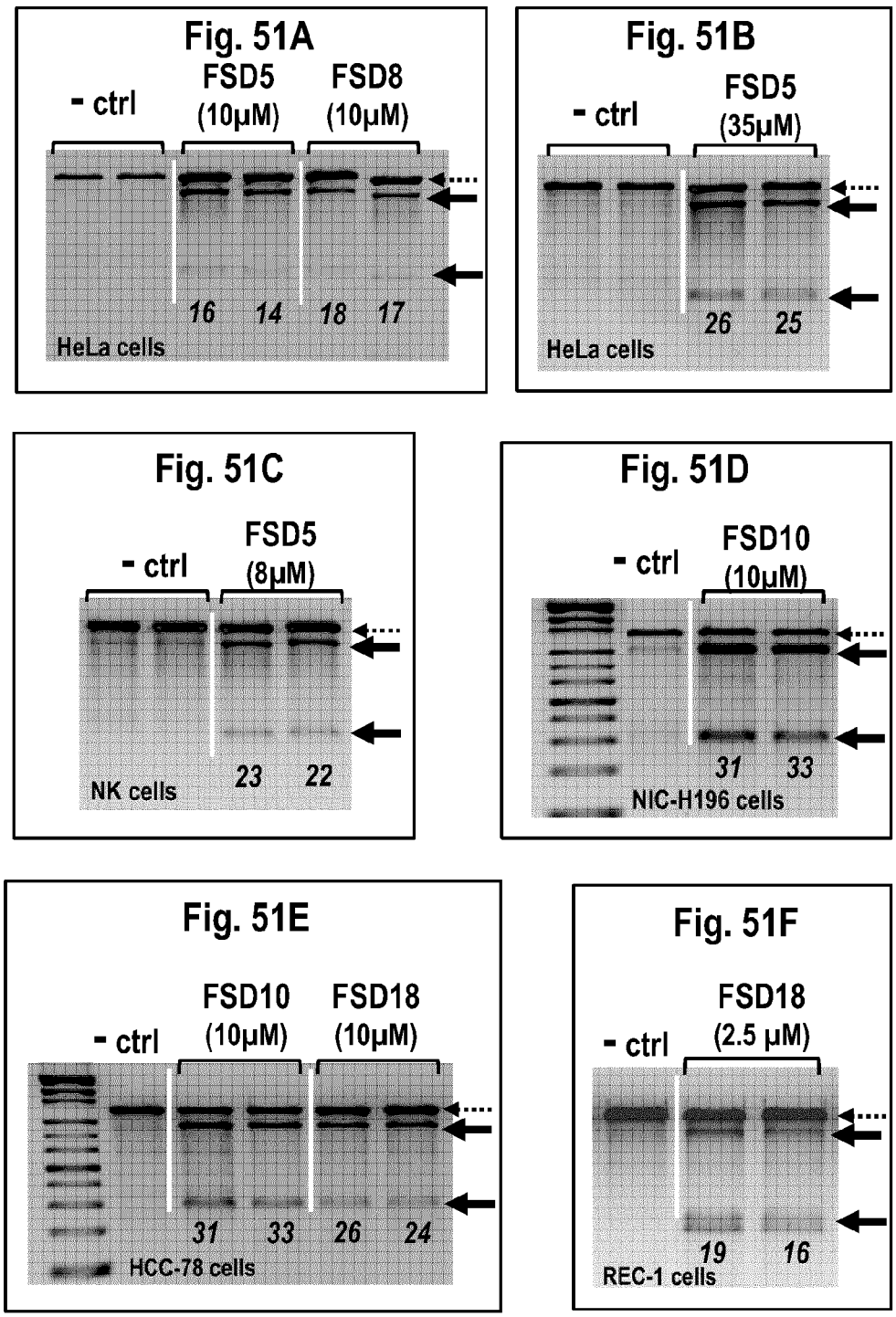

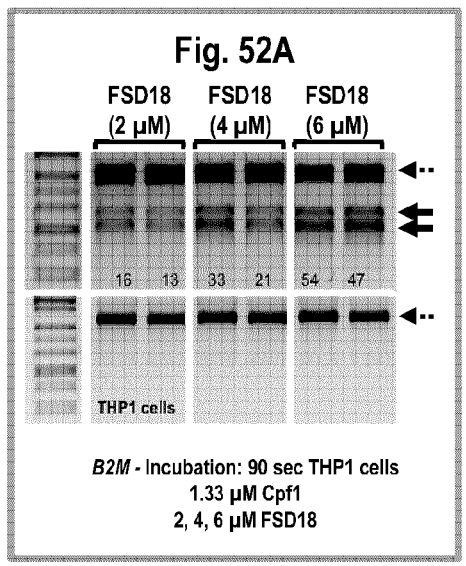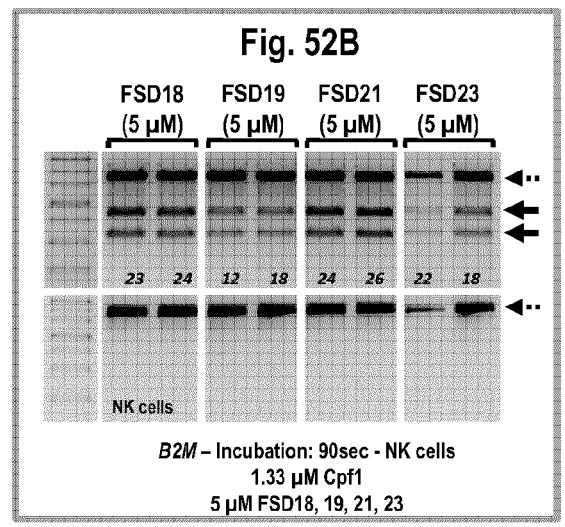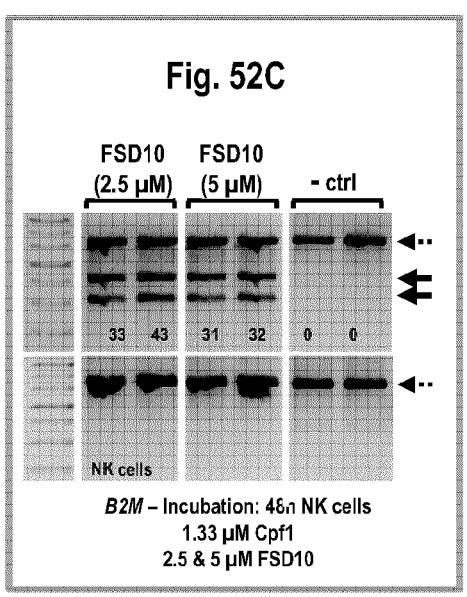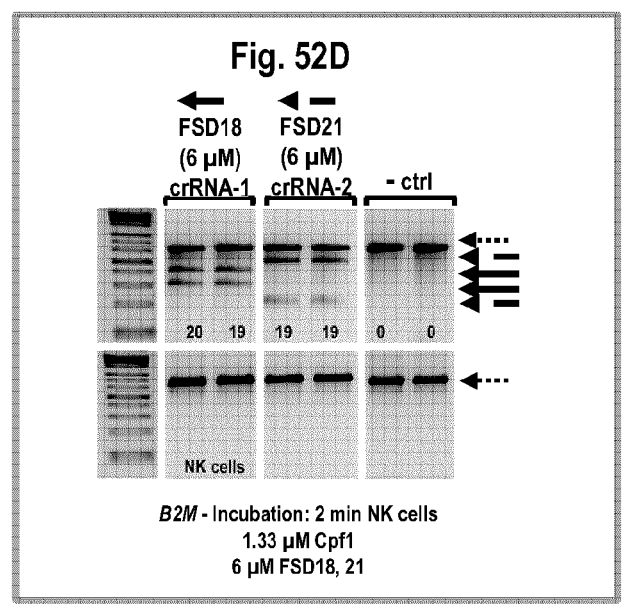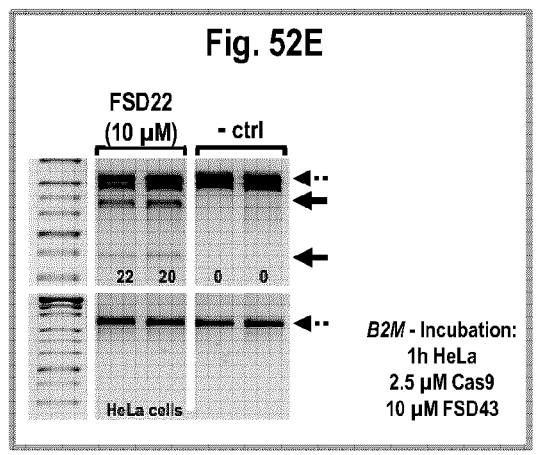

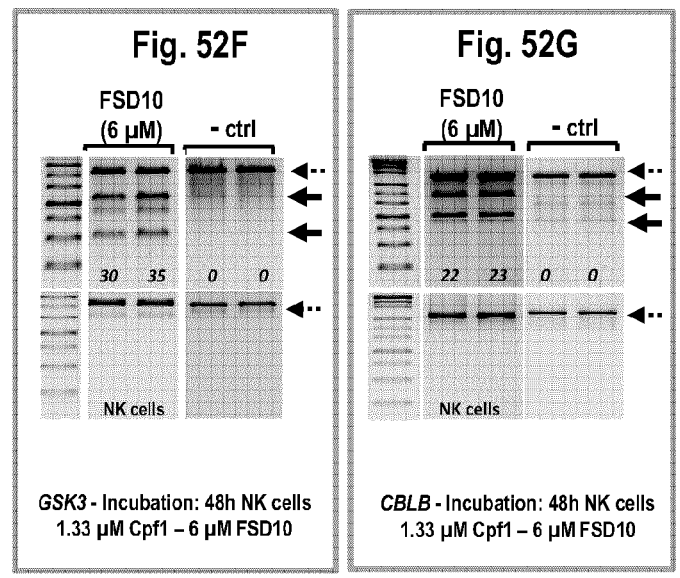
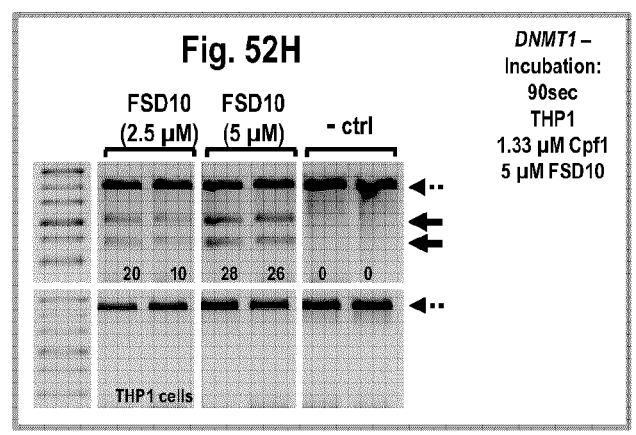
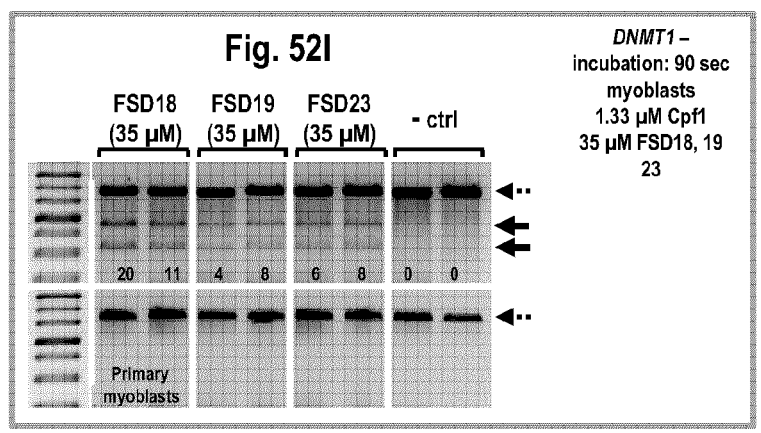

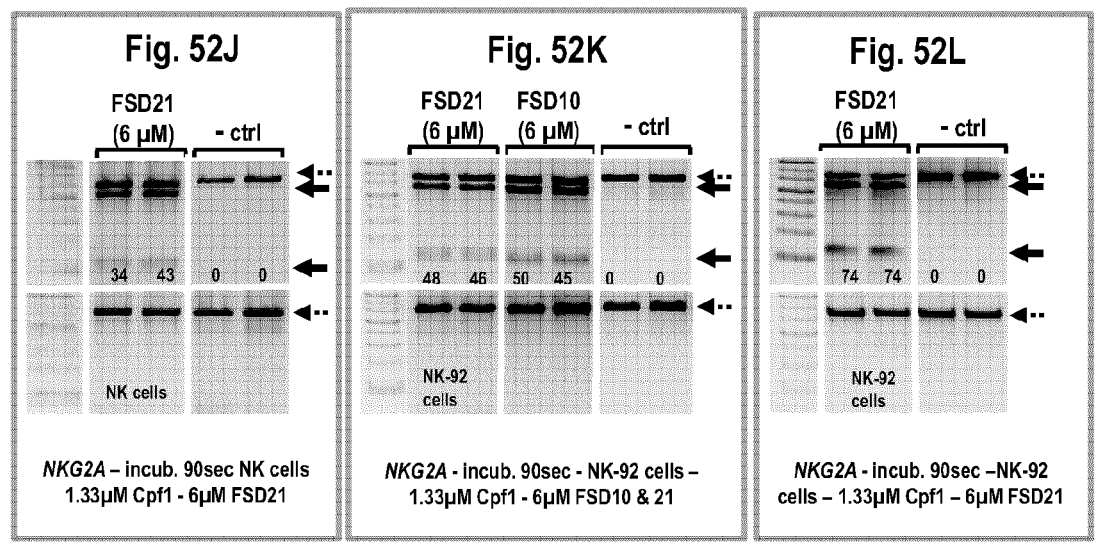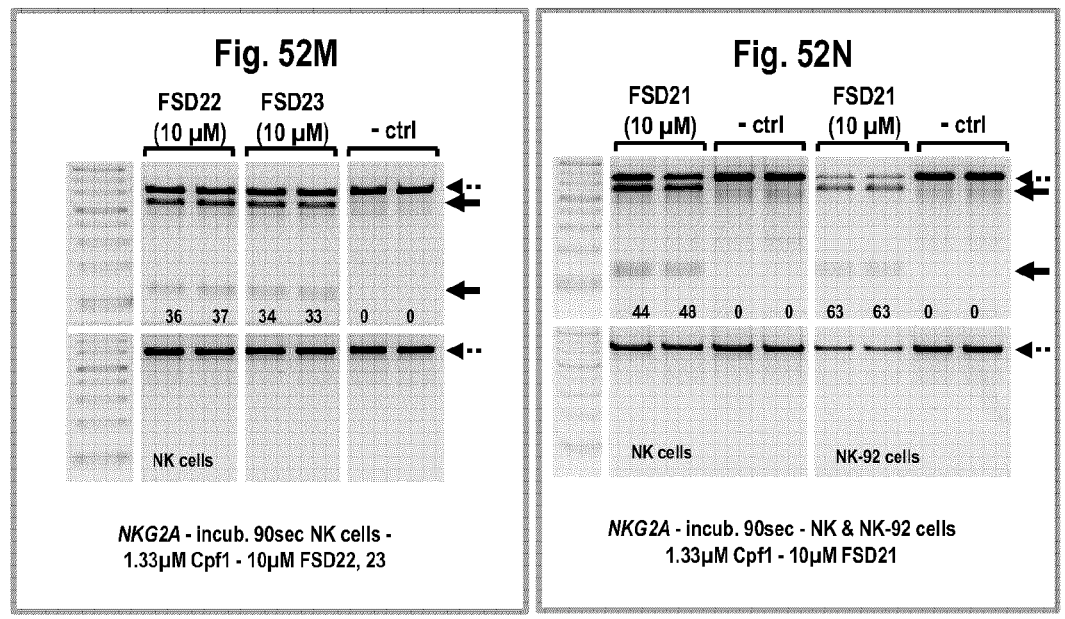

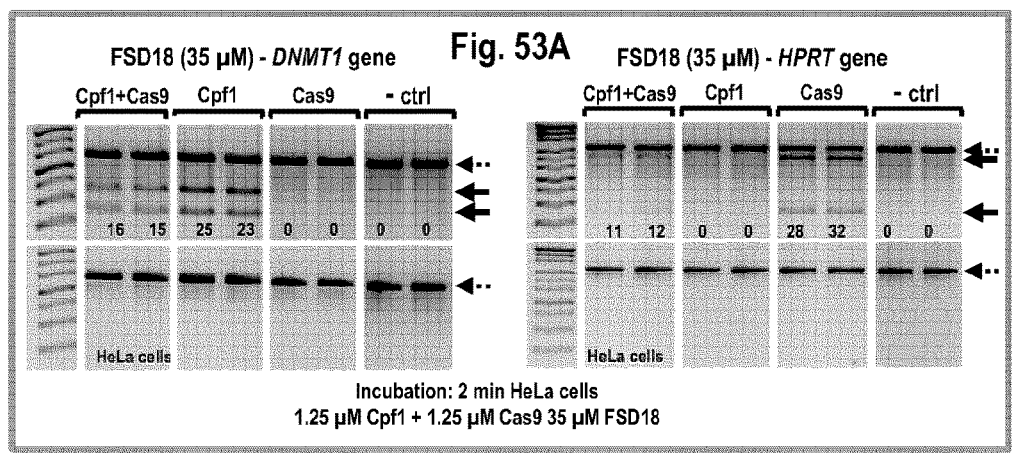
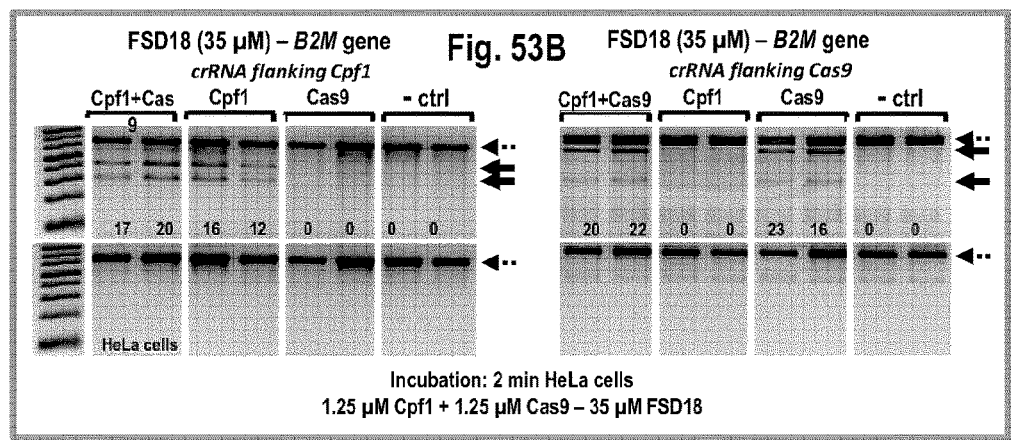
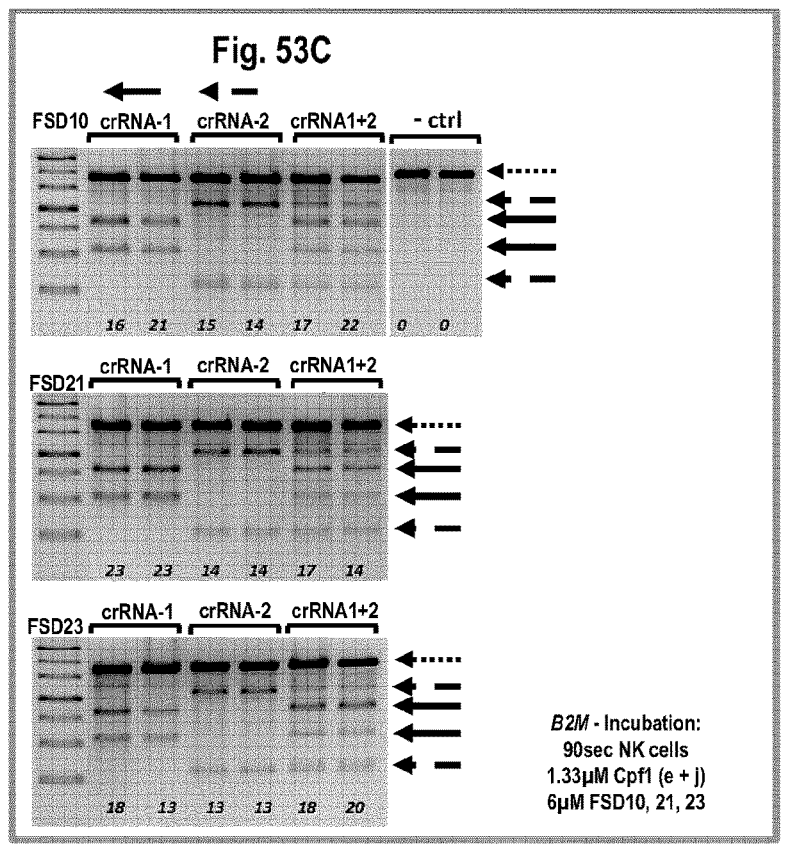

Untreated crRNA E crRNA G crRNA J crRNA E + G + J

FACS sorting for GFP-negative cells

FACS sorting for GFP-positive cells

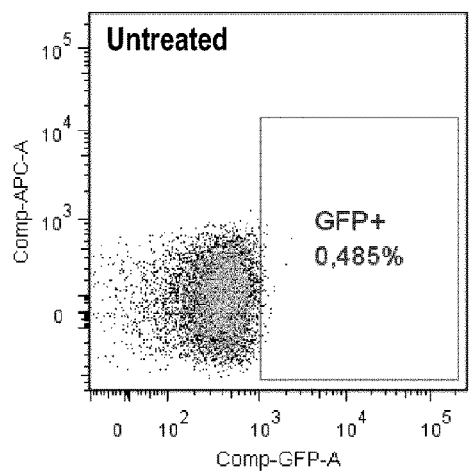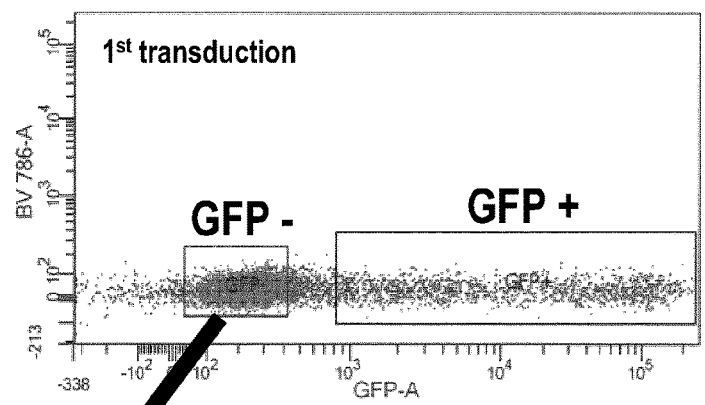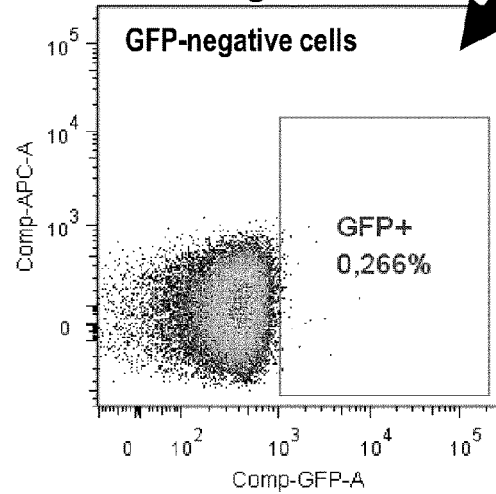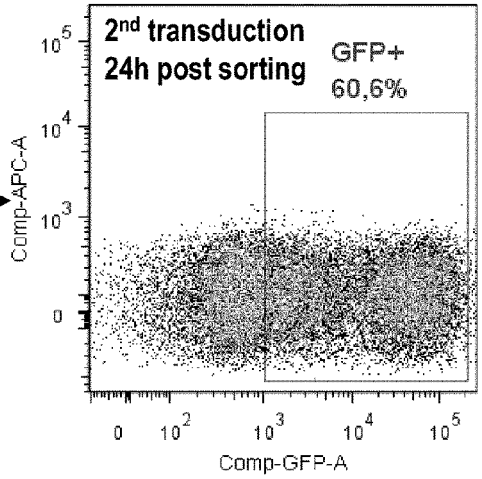

RATIONALLY-DESIGNED SYNTHETIC PEPTIDE SHUTTLE AGENTS FOR DELIVERING POLYPEPTIDE CARGOS FROM AN EXTRACELLULAR SPACE TO THE CYTOSOL AND/OR NUCLEUS OF A TARGET EUKARYOTIC CELL, USES THEREOF, METHODS AND KITS RELATING TO SAME

CROSS-REFERENCE

This application is filed pursuant to 35 U.S.C. § 371 as a United States National Phase Application of International Application No. PCT/CA2017/051205 filed Oct. 11, 2017, which is a Continuation of U.S. application Ser. No. 15/666,139 filed Aug. 1, 2017, now U.S. Pat. No. 9,982,267, issued May 29, 2018, which claims benefit of U.S. Provisional Patent Application No. 62/535,015 filed on Jul. 20, 2017, and U.S. Provisional Patent Application No. 62/407,232 filed on Oct. 12, 2016 which are incorporated herein by reference in their entirety.

The present description relates to synthetic peptide shuttle agents useful for delivering a variety of polypeptide cargos from an extracellular space to the cytosol and/or nucleus of target eukaryotic cells. More specifically, the present description relates to parameters useful in the rational design of such synthetic peptide shuttle agents.

BACKGROUND

Cell delivery technologies to transport large molecules inside eukaryotic cells have a wide range of applications, particularly in the biopharmaceutical industry. While some soluble chemical substances (e.g., small molecule drugs) may passively diffuse through the eukaryotic cell membrane, larger cargos (e.g., biologics, polynucleotides, and polypeptides) require the help of shuttle agents to reach their intracellular targets.

Areas that would greatly benefit from advances in cell delivery technologies include the fields of genome editing and cell therapy, which have made enormous leaps over the last two decades. Deciphering the different growth factors and molecular cues that govern cell expansion, differentiation and reprogramming open the door to many therapeutic possibilities for the treatment of unmet medical needs. For example, induction of pluripotent stem cells directly from adult cells, direct cell conversion (trans-differentiation), and genome editing (Zinc finger nuclease, TALEN and CRISPR-associated endonuclease technologies) are examples of methods that have been developed to maximize the therapeutic value of cells for clinical applications. Presently, the production of cells with high therapeutic activity usually requires ex vivo manipulations, mainly achieved by viral transduction, raising important safety and economical concerns for human applications. The ability to directly deliver active proteins such as transcription factors or artificial nucleases, inside these cells, may advantageously circumvent the safety concerns and regulatory hurdles associated with more risky gene transfer methods. In particular, methods of directly delivering active genome editing complexes in immune cells in order to improve immunotherapy would be highly desirable.

Protein transduction approaches involving fusing a recombinant protein cargo directly to a cell-penetrating peptide (e.g., HIV transactivating protein TAT) require large amounts of the recombinant protein and often fail to deliver the cargo to the proper subcellular location, leading to massive endosomal trapping and eventual degradation. Several endosomal membrane-disrupting peptides have been developed to try to facilitate the escape of endosomally-trapped cargos to the cytosol. However, many of these endosomolytic peptides have been used to alleviate endosomal entrapment of cargos that have already been delivered intracellularly, and do not by themselves aid in the initial step of shuttling the cargos intracellularly across the plasma membrane (Salomone et al., 2012; Salomone et al., 2013; Erazo-Oliveras et al., 2014; Fasoli et al., 2014).

In particular, Salomone et al., 2012 described a chimeric peptide $CM_{18}$-$TAT_{11}$, resulting from the fusion of the $Tat_{11}$ cell penetrating motif to the CM18 hybrid (residues 1-7 of Cecropin-A and 2-12 of Melittin). This peptide was reported to be rapidly internalized by cells (due to its TAT motif) and subsequently responsible for destabilizing the membranes of endocytic vesicles (due to the membrane disruptive abilities of the CM18 peptide). Although the peptide $CM_{18}$-$TAT_{11}$ fused to the fluorescent label Atto-633 (molecular weight of 774 Da; 21% of the MW of the peptide) was reported to facilitate the escape of endosomally trapped $TAT_{11}$-EGFP to the cytosol (see FIG. 3 of Salomone et al., 2012), the $CM_{18}$-$TAT_{11}$ peptide (alone or conjugated to Atto-633) was not shown to act as a shuttle agent that can increase delivery of a polypeptide cargo from an extracellular space to inside of the cell—i.e., across the plasma membrane. In fact, Salomone et al., 2012 compared co-treatment (simultaneous treatment of $TAT_{11}$-EGFP and $CM_{18}$-$TAT_{11}$-Atto-633) versus time-shifted treatment (i.e., incubation of cells with $TAT_{11}$-EGFP alone, fluorescence imaging, and then incubation of the same cells with the $CM_{18}$-$TAT_{11}$-Atto-633 peptide alone, and again fluorescence imaging), and the authors reported that "both yielded the same delivery results" (see page 295 of Salomone et al., 2012, last sentence of first paragraph under the heading "2.9 Cargo delivery assays"). In other words, Salomone et al., 2012 described that the peptide $CM_{18}$-$TAT_{11}$ (alone or conjugated to Atto-633) had no effect on delivery of a polypeptide cargo from an extracellular space to inside of the cell (i.e., protein transduction). Thus, there remains a need for improved shuttle agents capable of increasing the transduction efficiency of polypeptide cargos, and delivering the cargos to the cytosol and/or nucleus of target eukaryotic cells.

The present description refers to a number of documents, the content of which is herein incorporated by reference in their entirety.

SUMMARY

A plurality of different peptides was screened with the goal of identifying polypeptide-based shuttle agents that can deliver independent polypeptide cargos intracellularly to the cytosol/nucleus of eukaryotic cells. On one hand, these large-scale screening efforts led to the surprising discovery that certain domain-based peptide shuttle agents increase the transduction efficiency of polypeptide cargos in eukaryotic cells, by increasing the number and/or proportion of cells that ultimately internalize the polypeptide cargos, and also enable the internalized cargos to gain access to the cytosol/nuclear compartment (thus avoiding or reducing cargo endosomal entrapment). These domain-base shuttle agents comprise an endosome leakage domain (ELD) operably linked to a cell penetrating domain (CPD), and optionally one or more histidine-rich domains. On the other hand, the above screening efforts also revealed some peptides having no or low polypeptide cargo transduction activity, excessive toxicity, and/or other undesirable properties (e.g., poor solubility and/or stability). These empirical data (both positive and negative) were used herein to identify physiochemical properties of successful, less successful, and failed peptides in order to arrive at a set of design parameters that enable the rational design and/or identification of peptides having protein transduction activity.

Accordingly, the present description relates to methods for delivering polypeptide cargos from an extracellular space to the cytosol and/or nucleus of a target eukaryotic cell by contacting the cell with the polypeptide cargo in the presence of a peptide shuttle agent as described herein, at a concentration sufficient to increase the polypeptide cargo's transduction efficiency, as compared to in the absence of the shuttle agent. More particularly, the present description relates to parameters that may be used in the rational design of such synthetic peptide shuttle agents, peptide shuttle agents that satisfy one or more of these design parameters, as well as methods and compositions relating to the use of the synthetic peptide shuttle agents for delivery of a variety of polypeptide cargos from an extracellular space to the cytosol and/or nucleus of target eukaryotic cells. The present description also relates to machine-learning or computer-assisted approaches that may be used to generate peptide variants that respect one or more of the design parameters described herein.

The present description also relates to co-transducing a polypeptide cargo of interest and a marker protein as a means to identify and/or enrich transduced cells. It was surprisingly discovered that a strikingly high proportion of target eukaryotic cells that were successfully transduced with a polypeptide cargo of interest, were also successfully transduced with a marker protein. Conversely, a strikingly high proportion of cells that were not transduced with the polypeptide cargo of interest, were also not transduced with the marker protein. Isolating cells positive for the marker protein (e.g., via FACS) resulted in a significant increase in the proportion of cells that were successfully transduced with the polypeptide cargo of interest, and the correlation was found to be concentration dependent in that cell populations exhibiting the highest fluorescence of the marker protein also tended to exhibit the highest proportion of transduction with the polypeptide cargo of interest. It was also discovered that cells that were unsuccessfully transduced following a first round of transduction with a polypeptide cargo of interest, may be isolated and re-transduced with the polypeptide cargo of interest in subsequent rounds of transduction. Thus, in some aspects, the present description relates to methods comprising co-transduction of a polypeptide cargo of interest with a marker protein, wherein the marker protein may be used to isolate or enrich cells transduced with a polypeptide cargo of interest. In some embodiments, the present description also relates to methods comprising repeated successive transduction experiments performed on, for example, cells that were not successfully transduced with a marker protein following a first or previous transduction reaction. Such methods present attractive approaches for increasing transduction efficiency in valuable cell populations (e.g., patient-derived cells for cell therapy), and/or in cell populations that are inherently more difficult to transduce.

General Definitions

Headings, and other identifiers, e.g., (a), (b), (i), (ii), etc., are presented merely for ease of reading the specification and claims. The use of headings or other identifiers in the specification or claims does not necessarily require the steps or elements be performed in alphabetical or numerical order or the order in which they are presented.

The use of the word "a" or "an" when used in conjunction with the term "comprising" in the claims and/or the specification may mean "one" but it is also consistent with the meaning of "one or more", "at least one", and "one or more than one".

The term "about" is used to indicate that a value includes the standard deviation of error for the device or method being employed in order to determine the value. In general, the terminology "about" is meant to designate a possible variation of up to 10%. Therefore, a variation of 1, 2, 3, 4, 5, 6, 7, 8, 9 and 10% of a value is included in the term "about". Unless indicated otherwise, use of the term "about" before a range applies to both ends of the range.

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited elements or method steps.

As used herein, "protein" or "polypeptide" or "peptide" means any peptide-linked chain of amino acids, which may or may not comprise any type of modification (e.g., chemical or post-translational modifications such as acetylation, phosphorylation, glycosylation, sulfatation, sumoylation, prenylation, ubiquitination, etc.). For further clarity, protein/polypeptide/peptide modifications are envisaged so long as the modification does not destroy the protein transduction activity of the shuttle agents described herein As used herein, a "domain" or "protein domain" generally refers to a part of a protein having a particular functionality or function. Some domains conserve their function when separated from the rest of the protein, and thus can be used in a modular fashion. The modular characteristic of many protein domains can provide flexibility in terms of their placement within the shuttle agents of the present description. However, some domains may perform better when engineered at certain positions of the shuttle agent (e.g., at the N- or C-terminal region, or therebetween). The position of the domain within its endogenous protein is sometimes an indicator of where the domain should be engineered within the shuttle agent and of what type/length of linker should be used. Standard recombinant DNA techniques can be used by the skilled person to manipulate the placement and/or number of the domains within the shuttle agents of the present description in view of the present disclosure. Furthermore, assays disclosed herein, as well as others known in the art, can be used to assess the functionality of each of the domains within the context of the shuttle agents (e.g., their ability to facilitate cell penetration across the plasma membrane, endosome escape, and/or access to the cytosol). Standard methods can also be used to assess whether the domains of the shuttle agent affect the activity of the cargo to be delivered intracellularly. In this regard, the expression "operably linked" as used herein refers to the ability of the domains to carry out their intended function(s) (e.g., cell penetration, endosome escape, and/or subcellular targeting) within the context of the shuttle agents of the present description. For greater clarity, the expression "operably linked" is meant to define a functional connection between two or more domains without being limited to a particular order or distance between same.

As used herein, the term "synthetic" used in expressions such as "synthetic peptide" or "synthetic polypeptide" is intended to refer to non-naturally occurring molecules that can be produced in vitro (e.g., synthesized chemically and/or produced using recombinant DNA technology). The purities of various synthetic preparations may be assessed by, for example, high-performance liquid chromatography analysis and mass spectroscopy. Chemical synthesis approaches may be advantageous over cellular expression systems (e.g., yeast or bacteria protein expression systems), as they may preclude the need for extensive recombinant protein purification steps (e.g., required for clinical use). In contrast, longer synthetic polypeptides may be more complicated and/or costly to produce via chemical synthesis approaches and such polypeptides may be more advantageously produced using cellular expression systems. In some embodiments, the peptides or shuttle agent of the present description may be chemically synthesized (e.g., solid- or liquid phase peptide synthesis), as opposed to expressed from a recombinant host cell. In some embodiments, the peptides or shuttle agent of the present description may lack an N-terminal methionine residue. A person of skill in the art may adapt a synthetic peptide or shuttle agent of the present description by using one or more modified amino acids (e.g., non-naturally-occurring amino acids), or by chemically modifying the synthetic peptide or shuttle agent of the present description, to suit particular needs of stability or other needs.

The expression "polypeptide-based" when used here in the context of a shuttle agent of the present description, is intended to distinguish the presently described shuttle agents from non-polypeptide or non-protein-based shuttle agents such as lipid- or cationic polymer-based transduction agents, which are often associated with increased cellular toxicity and may not be suitable for use in human therapy.

As used herein, the term "independent" is generally intended refer to molecules or agents which are not covalently bound to one another. For example, the expression "independent polypeptide cargo" is intended to refer to a polypeptide cargo to be delivered intracellularly that is not covalently bound (e.g., not fused) to a shuttle agent of the present description. In some aspects, having shuttle agents that are independent of (not fused to) a polypeptide cargo may be advantageous by providing increased shuttle agent versatility—e.g., not being required to re-engineer a new fusion protein for different polypeptide cargoes, and/or being able to readily vary the ratio of shuttle agent to cargo (as opposed to being limited to a 1:1 ratio in the case of a fusion protein).

As used herein, the expression "is or is from" or "is from" comprises functional variants of a given protein domain (e.g., CPD or ELD), such as conservative amino acid substitutions, deletions, modifications, as well as variants or function derivatives, which do not abrogate the activity of the protein domain.

Other objects, advantages and features of the present description will become more apparent upon reading of the following non-restrictive description of specific embodiments thereof, given by way of example only with reference to the accompanying drawings.

BRIEF DESCRIPTION OF THE DRAWINGS

In the appended drawings:

FIG. 1A shows the results of a fluorescence microscopy experiment, while FIG. 1B shows the results of a flow cytometry experiment.

FIG. 22A shows a comparison of GFP-NLS transduction efficiencies using different transduction protocols (Protocol A vs. B). FIG. 22B shows the effect of using different concentrations of the shuttle His-CM18-PTD4 when using Protocol B.

FIGS. 23-26 are microscopy images showing the results of transduction experiments in which GFP-NLS (FIGS. 23, 24A, 24B, 25 and 26) or FITC-labeled anti-tubulin antibody (FIGS. 24C and 24D) cargo protein was intracellularly delivered with the shuttle His-CM18-PTD4 in HeLa cells. The bright field and fluorescence images of living cells are shown in FIGS. 23, 24 and 26. In FIG. 25, the cells were fixed, permeabilized and subjected to immuno-labelling with an anti-GFP antibody and a fluorescent secondary antibody. White triangle windows indicate examples of areas of co-labelling between nuclei (DAPI) and GFP-NLS signals. FIG. 26 shows images captured by confocal microscopy.

FIGS. 29A-29I show the results of GFP-NLS transduction efficiency experiments in HeLa cells using different shuttle agents or single-domain/control peptides. GFP-NLS transduction efficiency was evaluated by flow cytometry and the percentage of GFP fluorescent cells ("Pos cells (%)"), as well as corresponding cell viability data ("viability (%)") are shown in FIGS. 29A, 29B, 29D-29G and 29I. In FIGS. 29A and 29D-29F, cells were exposed to the cargo/shuttle agent for 10 seconds. In panel I, cells were exposed to the cargo/shuttle agent for 1 minute. In FIGS. 29B, 29C, 29G and 29H, cells were exposed to the cargo/shuttle agent for 1, 2, or 5 min. "Relative fluorescence intensity (FL1-A)" or "Signal intensity" corresponds to the mean of all fluorescence intensities from each cell with a GFP fluorescent signal after GFP-NLS fluorescent protein delivery with the shuttle agent. FIG. 29D shows the results of a control experiment in which only single-domain peptides (ELD or CDP) or the peptide His-PTD4 (His-CPD) were used for the GFP-NLS transduction, instead of the multi-domain shuttle agents.

FIGS. 30A-30F show microscopy images of HeLa cells transduced with GFP-NLS using the shuttle agent FIG. 30A: TAT-KALA, FIG. 30B: His-CM18-PTD4, FIG. 30C: His-C (LLKK)$_3$C-PTD4, FIG. 30D: PTD4-KALA, FIG. 30E: EB1-PTD4, and FIG. 30F: His-CM18-PTD4-His. The insets in the bottom row panels show the results of corresponding flow cytometry analyses, indicating the percentage of cells exhibiting GFP fluorescence.

FIGS. 32A-32D shows microscopy images of THP-1 cells transduced with GFP-NLS cargo protein using the shuttle His-CM18-PTD4. Images captured under at 4×, 10× and 40× magnifications are shown in FIGS. 32A-32C, respectively. White triangle windows in FIG. 32C indicate examples of areas of co-labelling between cells (bright field) and GFP-NLS fluorescence. FIG. 32D shows the results of corresponding flow cytometry analyses, indicating the percentage of cells exhibiting GFP fluorescence.

FIG. 33A-33D show microscopy images of THP-1 cells transduced with GFP-NLS cargo protein using the shuttle His-CM18-PTD4. White triangle windows indicate examples of areas of co-labelling between cells (bright field; FIGS. 33A and 33B), and GFP-NLS fluorescence (FIG. 33C and FIG. 33D).

In FIG. 34B, "Relative fluorescence intensity (FL1-A)" corresponds to the mean of all fluorescence intensities from each cell with a GFP fluorescent signal after GFP-NLS fluorescent protein delivery with the shuttle agent.

FIG. 35D shows the metabolic activity index of the THP-1 cells after 1, 2, 4, and 24 h, and FIG. 35E shows the metabolic activity index of the THP-1 cells after 1 to 4 days, for cells exposed to the His-CM18-PTD4 shuttle.

FIG. 36 shows a comparison of the GFP-NLS transduction efficiencies in a plurality of different types of cells (e.g., adherent and suspension, as well as cell lines and primary cells) using the shuttle His-CM18-PTD4, as measured by flow cytometry. The results are expressed as the percentage of GFP fluorescent cells ("Pos cells (%)"), as well as corresponding cell viability data ("viability (%)").

FIGS. 37A-37H show fluorescence microscopy images of different types of cells transduced with GFP-NLS cargo using the shuttle His-CM18-PTD4. GFP fluorescence was visualized by fluorescence microscopy at a 10× magnification. The results of parallel flow cytometry experiments are also provided in the insets (viability and percentage of GFP-fluorescing cells).

In FIGS. 40E-40H, HeLa cells were transfected with the plasmid surrogate and then transduced with an active CRISPR/Cas9-NLS complex using the shuttle His-CM18-PTD4. CRISPR/Cas9-NLS-mediated cleavage of the plasmid surrogate at the STOP codon, and subsequent DNA repair by the cell, enables expression of GFP (FIGS. 40F and 40H) in addition to mCherry™ (panels 40E and 40G).

FIG. 46A shows the results with the shuttle agents: His-CM18-PTD4, His-CM18-PTD4-His, and His-C(LLKK)3C-PTD4 in HeLa cells. FIG. 46B shows the results with His-CM18-PTD4-His and His-CM18-L2-PTD4 in Jurkat cells. Negative controls (lane 4 in panels A and B) show amplified HPTR DNA sequence after incubation of the cells with the CRISPR/Cas9 complex without the presence of the shuttle agent. Positive controls (lane 5 in panels A and B) show the amplified HPTR DNA sequence after incubation of the cells with the Cas9/RNAs complex in presence of a commercial lipidic transfection agent.

FIG. 48B shows the stereotaxic coordinates of the injection site (black arrows) from the rat brain atlas of Franklin and Paxinos. The injection of GFP-NLS in presence of His-CM18-PTD4 was performed on the left part of the brain, and the negative control (injection of GFP-NLS alone), was done on the contralateral site. The black circle and connected black lines in FIG. 48B show the areas observed in the fluorescent pictures (FIGS. 48A, 48C and 48D)

FIGS. 49A and 49B show helical wheel (left panels) and "open cylinder" (right panels) representations of the peptides FSD5 and VSVG-PTD4, respectively. The geometrical shape of each amino acid residue corresponds to its biochemical property based on the residue's side chain (i.e., hydrophobicity, charge, or hydrophilicity). One of the main differences between the two opened cylindrical representations of FSD5 and VSVG-PTD4 is the presence of a highly hydrophobic core in FSD5 (outlined in FIG. 49A, left and right panels), which is not present in VSVG-PTD4. The cylinder in the lower middle panels of FIGS. 49A and 49B represent simplified versions of the opened cylindrical representations in the right panels, in which: "H" represents the high hydrophobic surface area; "h" represents low hydrophobic surface area; "+" represents positively charged residues; and "h" represent hydrophilic residues.

FIG. 49G shows a multiple sequence alignment of the peptides His-CM18-PTD4; EB1-PTD4; His-C(LLKK)$_3$C-PTD4; FSD5; FSD10; FSD19; FSD20; FSD21; FSD44; FSD46; and FSD63, along with "Consistency" scores for each residue position. For the alignment, histidine-rich domains were voluntarily excluded.

FIG. 50A shows the cytoplasmic transduction of a Goat Anti-Rabbit IgG H&L (Alexa Fluor® 594) antibody visualized by bright field (upper panel) and fluorescence microscopy (lower panel) at 20× magnification. FIGS. 50B and 50C show the cytoplasmic transduction of a Goat Anti-Mouse IgG H&L (Alexa Fluor® 488) antibody visualized by bright field (upper panels) and fluorescence microscopy (lower panels) at 10× and 20× magnifications, respectively.

FIGS. 51A-51F show the results of genome editing experiments in which CRISPR/Cas9-NLS genome editing complexes were transduced into different cell types (HeLa, NK cells, NIC-H196 cells, HCC-78 cells, and REC-1 cells) using different shuttle agent peptides (FSD5, FSD8, FSD10, FSD18), and successful genome editing was verified by genomic DNA cleavage assays. The CRISPR/Cas9-NLS complexes consisted of recombinant Cas9-NLS complexed with a crRNA/tracrRNA designed to cleave the HPRT genomic DNA sequence. Successful genome editing was observed by the detection of genomic DNA cleavage products (thick solid arrows), as compared to the uncleaved genomic target gene (thin dashed arrows). The negative control (− ctrl") were from transduction experiments performed in the absence of any shuttle agent peptide. An imaging software was used to quantify the relative signal intensities of the cleavage product bands directly on gels. The sum of all the bands in a given lane corresponds to 100% of the signal, and the numerical value in italics at the bottom of each lane is the sum of the relative signals (%) of only the two cleavage product bands (thick solid arrows).

FIGS. 52A-52E show the results of the cleavage of a targeted genomic B2M DNA sequence with the CRISPR/Cas9-NLS and the crRNA/tracrRNA, or with the CRISPR/Cpf1-NLS and a single guide RNA in the absence ("− ctrl") or presence of the shuttle agents FSD10, FSD18, FSD19, FSD21, FSD23 or FSD43 used at different concentrations, exposure times, and in different types of cells: THP-1 (FIG. 52A); NK (FIGS. 52B-D) and HeLa (FIG. 52E), after separation by agarose gel electrophoresis. Cells were incubated with CRISPR/Cpf1 complexes and FSD shuttle agents at the indicated times and concentrations. Thin dashed arrows indicate the bands corresponding to the target gene, and thicker solid arrows indicate the bands corresponding to the CRISPR system-mediated cleavage products of this target gene, which indicate the successful transduction of fully functional CRISPR/Cas9-NLS genome editing complexes. An imaging software was used to quantify the relative signal intensities of each of the different bands directly on gels. The sum of all the bands in a given lane corresponds to 100% of the signal, and the numerical value in italics at the bottom of each lane is the sum of the relative signals (%) of only the two cleavage product bands (thick solid arrows).

FIGS. 52F-52I show the results of the cleavage of a targeted genomic GSK3 (FIG. 52F), CBLB (FIG. 52G) and DNMT1 (FIG. 52H-I) DNA sequence with the CRISPR/Cpf1-NLS and a single guide crRNA in the absence ("− ctrl") or presence of the shuttle agents FSD10, FSD18, FSD19 or FSD23 used at different concentrations, exposure times, and in different types of cells: NK (FIG. 52F-G); THP-1 (FIG. 52H) and primary myoblasts (FIG. 52I), after separation by agarose gel electrophoresis. Cells were incubated with CRISPR/Cpf1 complexes and FSD at the indicated times and concentrations. Thin dashed arrows indicate the bands corresponding to the target gene, and thicker solid arrows indicate the bands corresponding to the CRISPR system-mediated cleavage products of these target genes, which indicate the successful transduction of fully functional CRISPR/Cpf1-NLS genome editing complexes.

FIGS. 52J-52N show the results of the cleavage of a targeted genomic NKG2A DNA sequence with the CRISPR/

Cpf1-NLS and a single guide crRNA in the absence ("– ctrl") or presence of the shuttle agents FSD10, FSD21, FSD22 or FSD23 used at different concentrations, exposure times, and in NK cells (FIGS. 52F-52G) and NK-92 cells (FIG. 52H), after separation by agarose gel electrophoresis. Cells were incubated with CRISPR/Cpf1 complexes for the indicated incubation times and concentrations. Thin dashed arrows indicate the bands corresponding to the target gene, and thicker solid arrows indicate the bands corresponding to the CRISPR system-mediated cleavage products of this target gene, which indicate the successful transduction of fully functional CRISPR/Cpf1-NLS genome editing complexes.

FIGS. 53A-53C show the results of the cleavage of the targeted genomic HPRT, DNMT1 and B2M DNA sequences with CRISPR systems. The two genomic HPRT and DNMT1 (FIG. 53A) DNA sequences or two DNA loci on the genomic B2M exon 2 (FIG. 53B) were targeted in HeLa cells using CRISPR/Cas9-NLS and CRISPR/Cpf1-NLS genome editing complexes designed for those purposes, which were transduced using the shuttle agent peptide FSD18. The two DNA loci on the genomic B2M exon 2 (FIG. 53C) were targeted in NK cells with the CRISPR/Cpf1-NLS and single guide crRNA-1, crRNA-2 or both, in the absence ("– ctrl") or presence of the shuttle agents FSD10, FSD21 or FSD23 used at different concentrations, exposure times, after separation by agarose gel electrophoresis. Thin dashed arrows indicate the bands corresponding to the target gene, and thicker solid arrows indicate the bands corresponding to the CRISPR/Cpf1-mediated cleavage products in presence of the crRNA-1 or crRNA2 or both (crRNA1+2) for the B2M exon 2, which indicate the successful transduction of fully functional CRISPR/Cpf1-NLS genome editing complexes.

FIGS. 54A-54D show the results of flow cytometry assays in which T cells were treated with increasing concentrations of the shuttle agent FSD21 (8 µM in FIG. 54B, 10 µM in FIG. 54C, and 12 µM in FIG. 54D), 1.33 µM of CRISPR/Cpf1-NLS system and 2 µM of single guide crRNA targeting a B2M genomic DNA sequence. HLA-positive and HLA-negative (B2M knock-out) cells were identified 72 hours after treatment by using an APC-labeled Mouse Anti-Human HLA-ABC antibody. Left-shifted cell populations indicated successful inactivation of cell surface HLA receptors, resulting from inactivation of the B2M gene.

FIGS. 55A-55D show the results of flow cytometry assays in which T cells were treated with increasing concentrations of the shuttle agent FSD18 (8 µM in FIG. 55B, 10 µM in FIG. 55C, and 12 µM in FIG. 55D), 1.33 µM of CRISPR/Cpf1-NLS system and 2 µM of single guide crRNA targeting a B2M DNA sequence. HLA-positive and HLA-negative (B2M knock-out) cells were identified 72 hours after treatment by using an APC-labeled Mouse Anti-Human HLA-ABC antibody. Left-shifted cell populations indicated successful inactivation of cell surface HLA receptors, resulting from inactivation of the B2M gene.

Figure 56A:
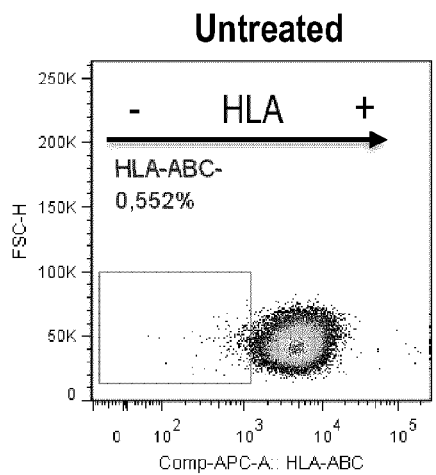
Figure 56B:
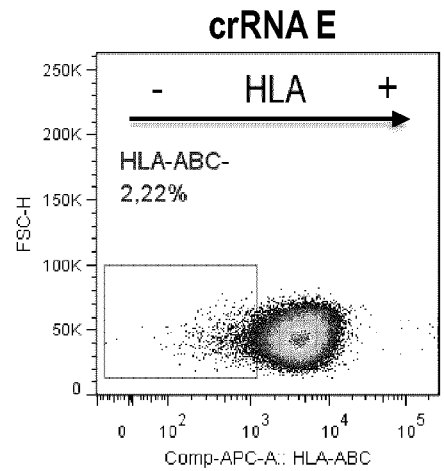
Figure 56C:
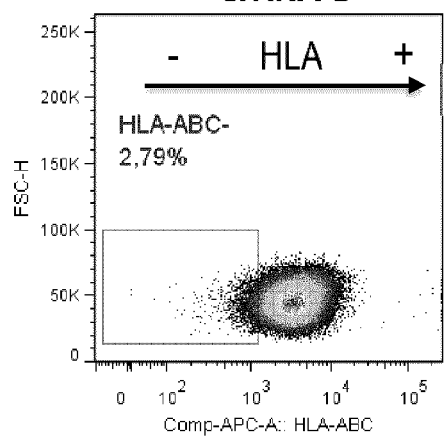
Figure 56D:
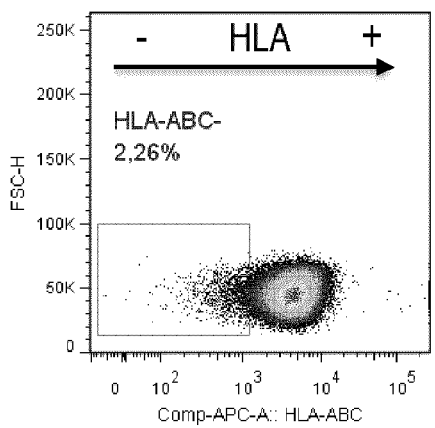
Figure 56E:
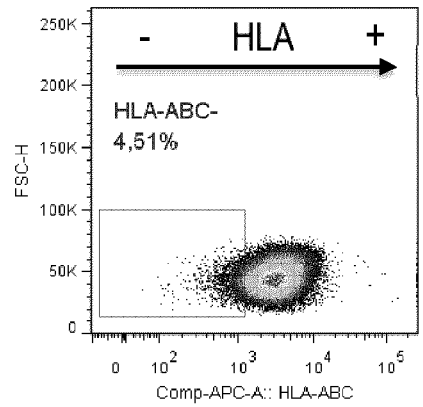

FIGS. 56A-56E show the results of flow cytometry assays in which THP-1 cells were treated (FIG. 56B-56E) or not ("untreated", FIG. 56A) with a mixture of 1.33 µM of CRISPR/Cpf1-NLS system, 2 µM of one or three guide crRNA each targeting different sites within the B2M genomic DNA sequence and 3 µM of FSD18. HLA-positive and HLA-negative (B2M knock-out) cells were identified 48 hours after treatment by using an APC-labeled Mouse Anti-Human HLA-ABC antibody in untreated cells (FIG. 56A), crRNA E treated cells (FIG. 56B), crRNA G treated cells (FIG. 56C), crRNA J treated cells (FIG. 56D) and crRNA E+G+J treated cells (FIG. 56E). Left-shifted cell populations indicated successful inactivation of cell surface HLA receptors, resulting from inactivation of the B2M gene.

Figure 57A:
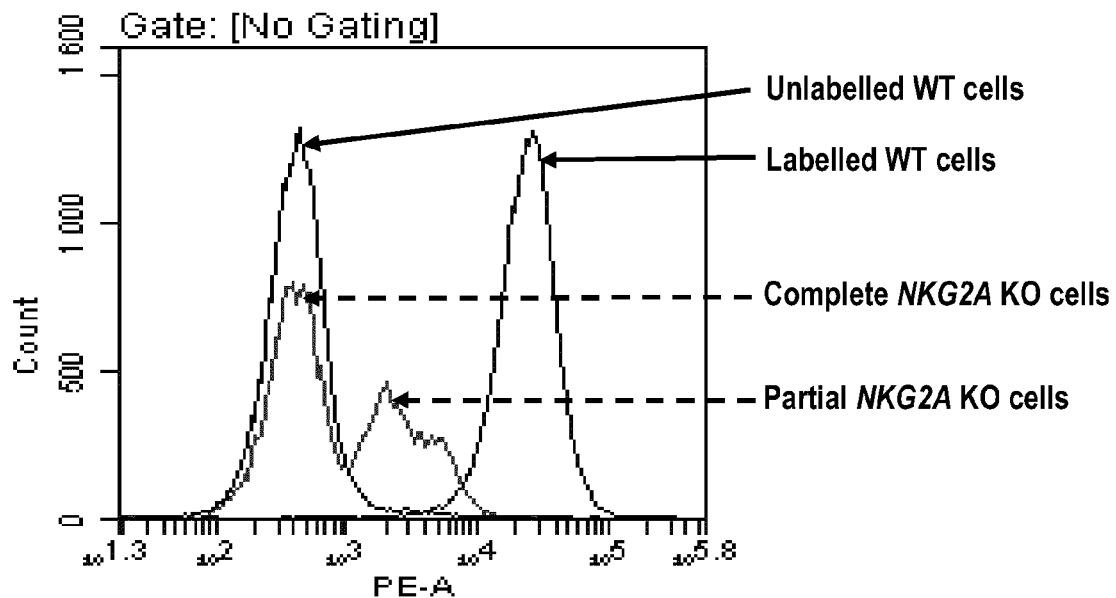
Figure 57B:
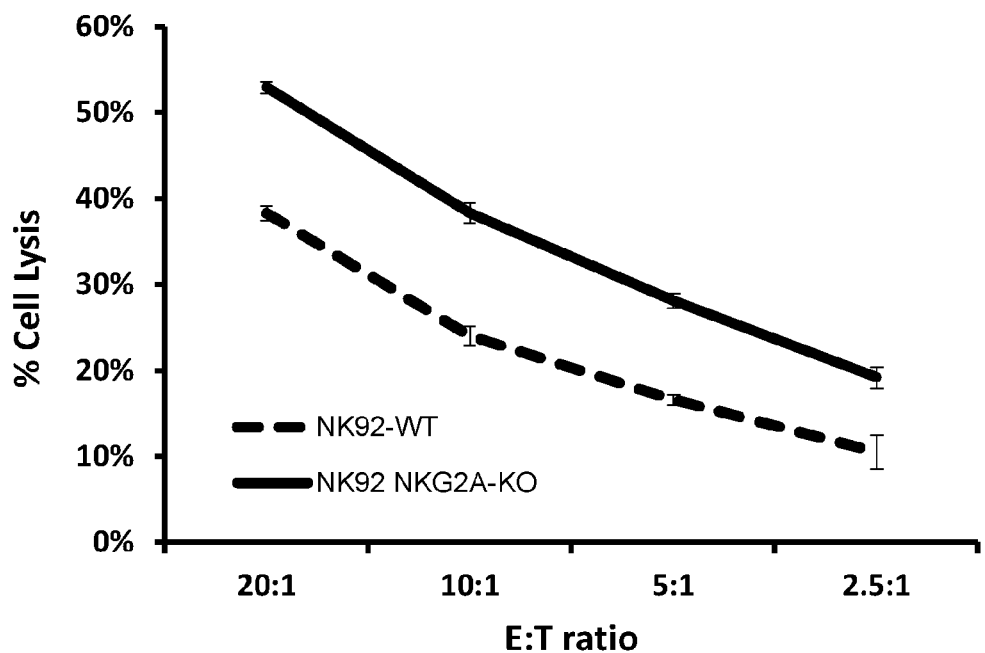

FIGS. 57A and 57B show the results of experiments in which NK-92 cells were genome-edited to determine whether inactivation of the endogenous NKG2A gene could increase their ability to kill target HeLa cells. Briefly, NK-92 cells were transduced with a CRISPR/Cpf1-NLS genome editing complex designed to cleave the NKG2A gene using the shuttle agent peptide FSD23. After transduction, NK-92 cells were immunolabelled with a phycoerythrin (PE)-labelled anti-NKG2A antibody and then analyzed by flow cytometry as shown in FIG. 57A, to verify successful inactivation of NKG2A. As controls, unlabelled wild-type NK-92 cells ("unlabelled WT cells") had no antibody signal, and labelled wild-type NK-92 cells ("labelled WT cells") had full immunolabelling signal. For NKG2A-KO NK-92 cells, two cell populations (peaks) were observed: one with a complete knock-out of NKG2A receptor expression on the cell surface ("Complete NKG2A KO cells"), and the other with a partial lack of expression ("Partial NKG2A KO cells"). FIG. 57B shows the results of cytotoxicity assays in which target HeLa cells previously loaded with an intracellular fluorescent dye (calcein) were exposed to either wild-type (solid line) or genome edited NKG2A-KO (dotted line) effector NK-92 cells, at different Effector:Target ratios (E:T ratio). Cytotoxicity was evaluated by the relative release of intracellular calcein into the extracellular space resulting from disruption of the cell membranes of the target HeLa cells (% cell lysis").

Figure 58A:
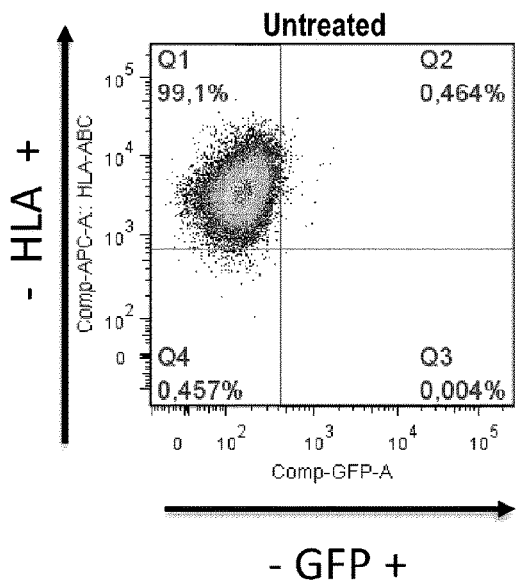
Figure 58B:
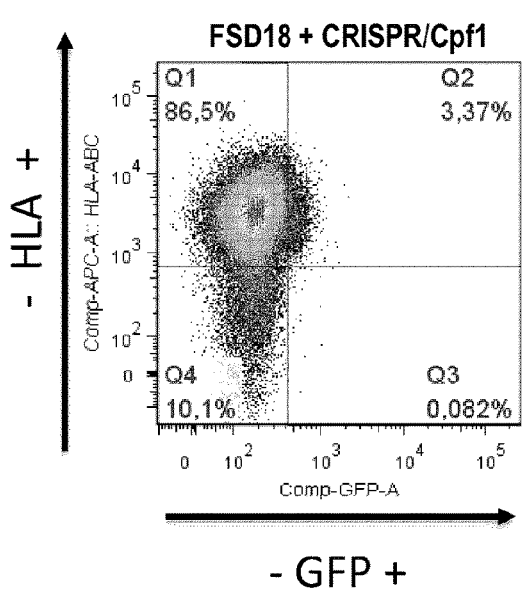
Figure 58C:
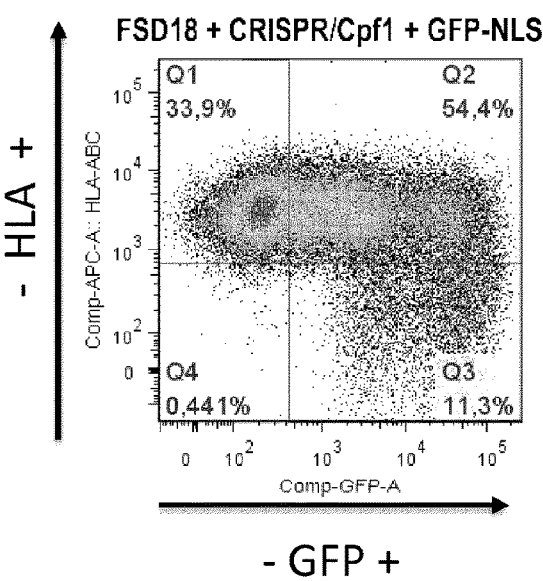
Figure 58D:
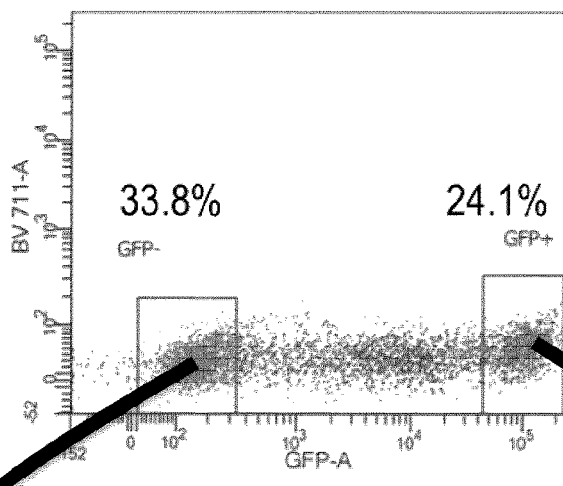
Figure 58E:
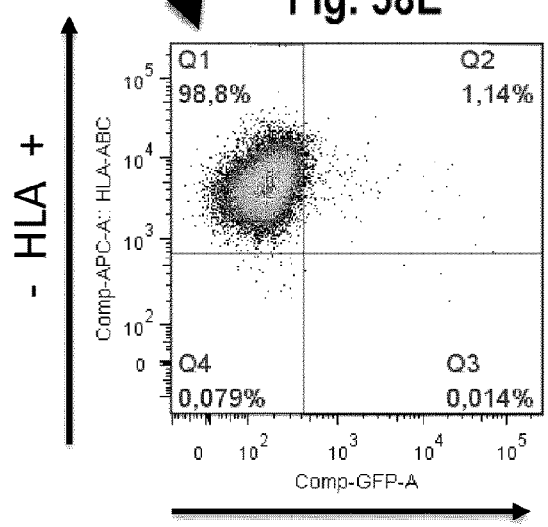
Figure 58F:
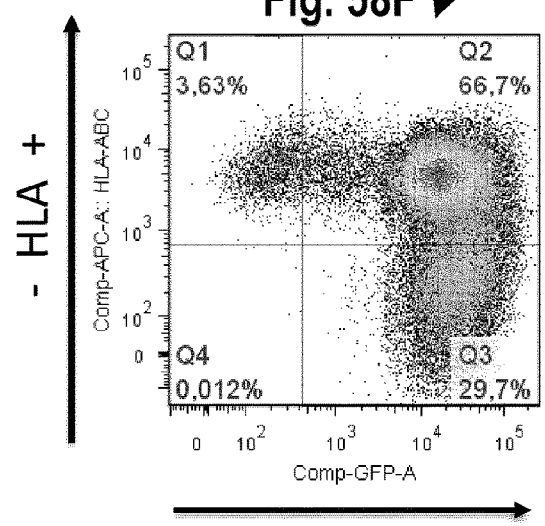
Figure 58G:
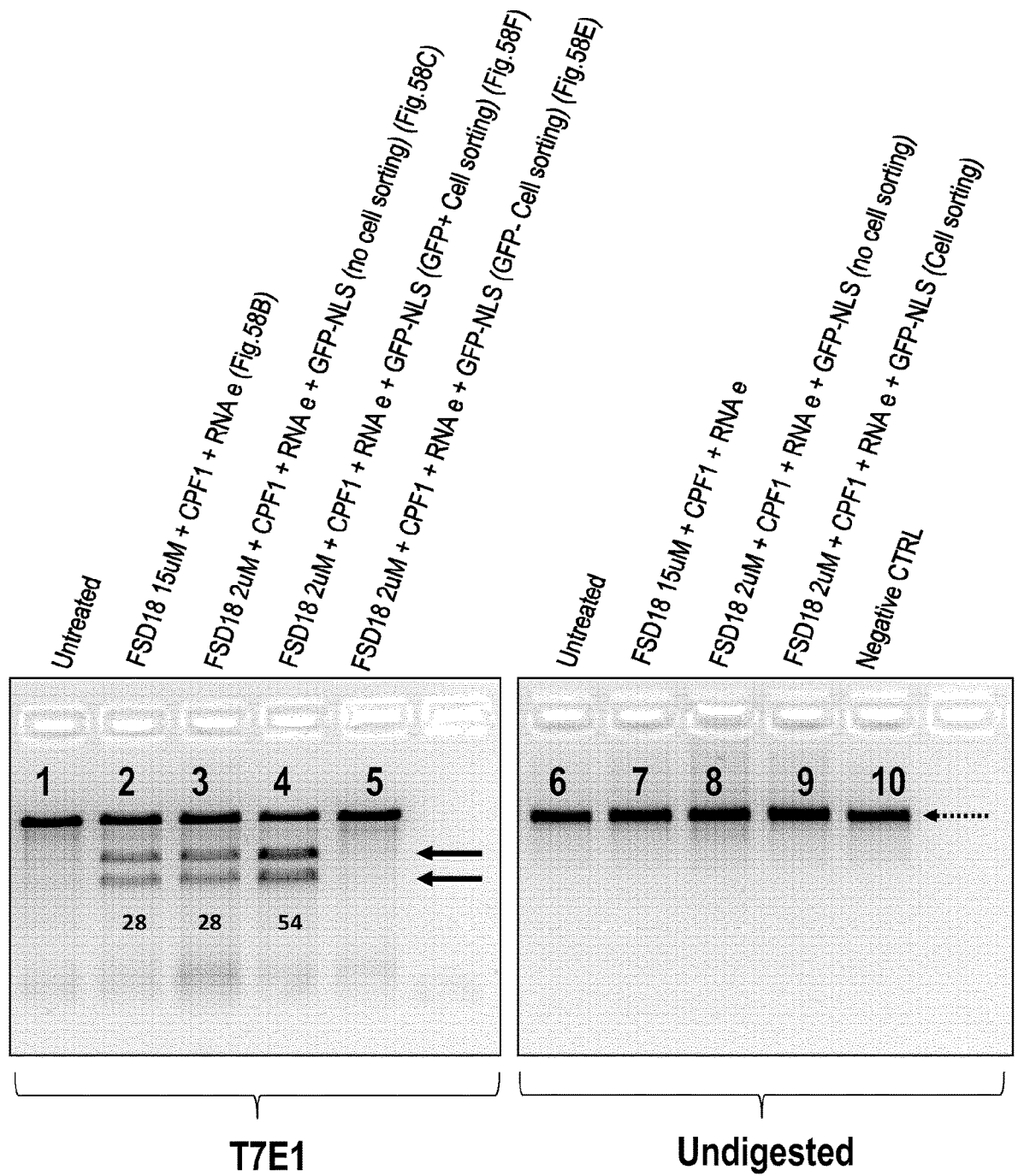

FIGS. 58A-58F show the results of flow cytometry assays in which T cells were treated (FIG. 58A-58F) or not ("untreated", FIG. 58A) with a mixture of GFP-NLS, a CRISPR/Cpf1-NLS complex designed to cleave the B2M genomic DNA sequence, and the shuttle agent FSD18. FIGS. 58B and 58C show the results of a two-dimensional flow cytometry analysis 5 h after treatment based on GFP fluorescence (x-axis) and cell surface HLA expression (y-axis). Fluorescence-activated cell sorting (FIG. 58D) of cells based on their GFP-fluorescence into a GFP-negative fraction (FIG. 58E) and a GFP-positive fraction (FIG. 58F) resulted in an increase in the proportion of genome-edited (HLA-negative) cells to 29.7% in the GFP-positive fraction (FIG. 58F). Each cell fraction was then subjected to a standard T7E1 cleavage assay followed by agarose gel electrophoresis to evaluate the effectiveness of the genome editing. The results are shown in FIG. 58G, wherein thin dashed arrows indicate the bands corresponding to the target gene, and thicker solid arrows indicate the bands corresponding to the CRISPR system-mediated cleavage products of this target gene. The values at the bottom of lanes 2, 3 and 4 correspond to the relative signal intensities (%) of the cleavage product bands (solid arrows) in that lane.

Figure 59A:
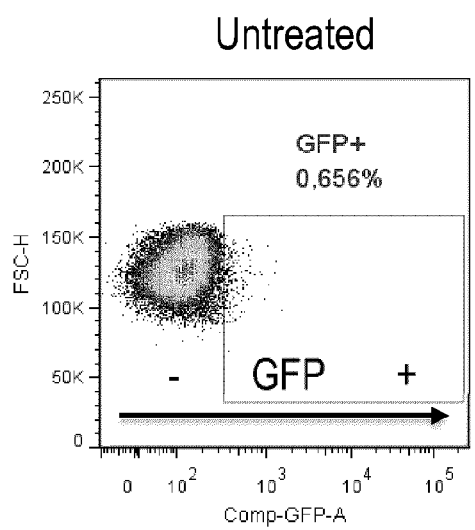
Figure 59B:
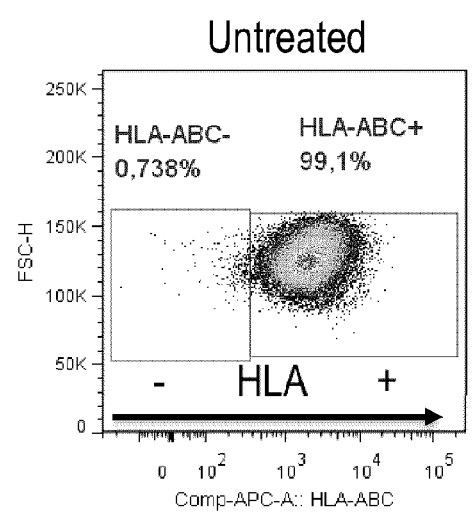
Figure 59C:
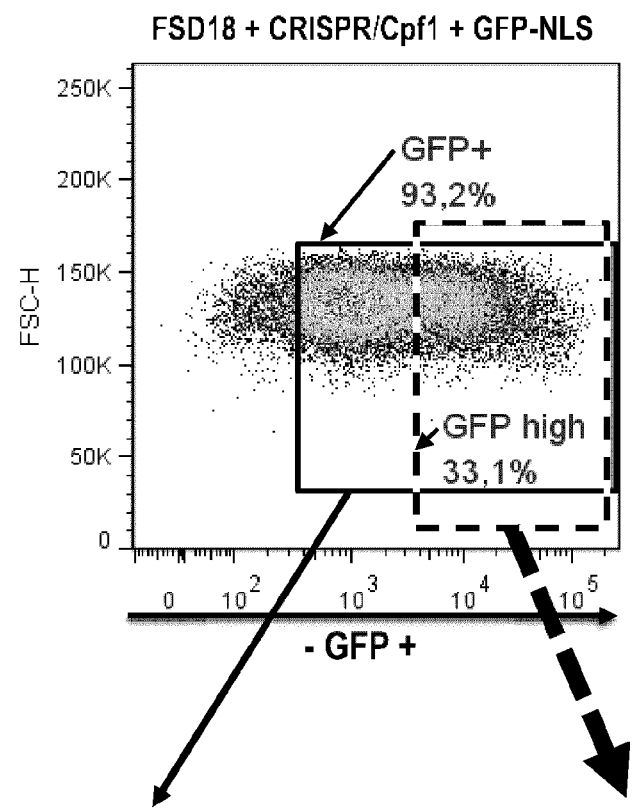
Figure 59D:
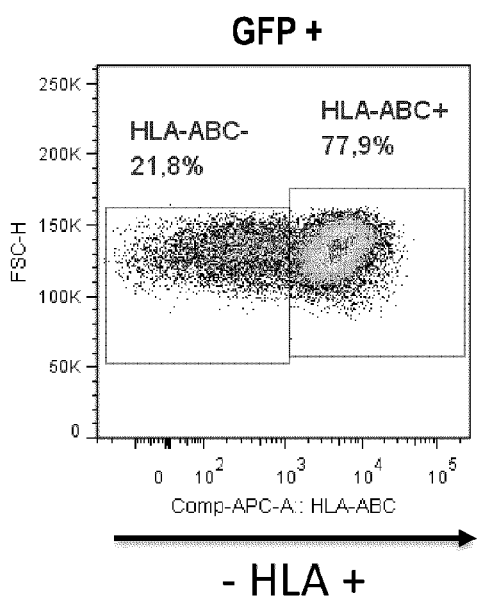
Figure 59E:
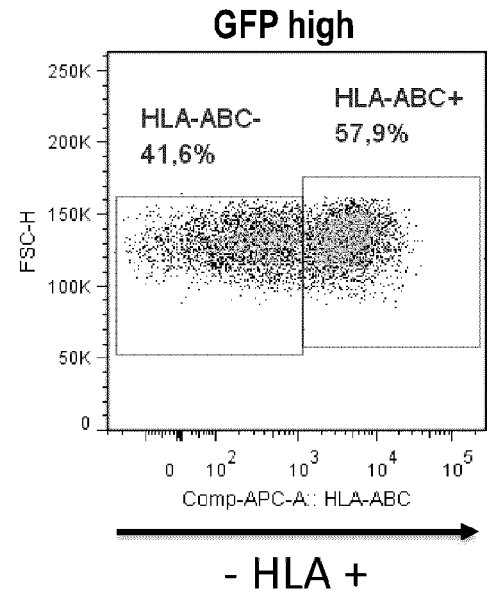

FIGS. 59A-59E show the results of flow cytometry assays in which T cells were treated (FIG. 59C-59E) or not ("untreated", FIGS. 59A and 59B) with a mixture GFP-NLS, a CRISPR/Cpf1-NLS complex designed to cleave the endogenous B2M gene, and the shuttle agent FSD18. FIGS. 59A and 59B, show the results of "untreated" negative control cells not exposed to the peptide shuttle agent, GFP, nor CRISPR/Cpf1, which were analyzed by flow cytometry for GFP fluorescence (FIG. 59A) and cell surface HLA expression (FIG. 59B). T cells were co-transduced with both GFP-NLS and CRISPR/Cpf1 via the peptide FSD18, and the resulting GFP fluorescence distribution is shown in FIG. 59C. The two gates shown in FIG. 59C indicate the fraction of cells that were considered to be GFP-positive ("GFP+";

93.2%; solid gate) and the sub-fraction of cells that were considered as exhibiting high GFP fluorescence ("GFP high"; 33.1%; dotted gate). Fluorescence-activated cell sorting was performed to quantify the level of cell surface HLA expression in cells considered to be GFP-positive (FIG. 59D) as compared to cells considered as exhibiting high GFP fluorescence (FIG. 59E). The above co-transduction experiment was repeated using 12 μM or 15 μM FSD18, followed by fluorescence-activated cell sorting into GFP-positive and GFP-negative cell fractions. Each fraction was subjected to a standard T7E1 cleavage assay, and the different samples were subjected to agarose gel electrophoresis.

FIG. 60 shows the results of a flow cytometry analysis in which T cells were subjected to a first transduction (FIG. 60B) or not ("untreated", FIG. 60A) with the cargo GFP-NLS using the peptide FSD18. The first transduction resulted in a GFP-NLS transduction efficiency of 55.4% (FIG. 60B). Fluorescence-activated cell sorting was performed to isolate GFP-negative cells (FIG. 60C) following the first transduction, and this GFP-negative cell population was subjected to a second transduction with GFP-NLS using the peptide FSD18. The results from this second transduction are shown in FIG. 60D, in which the GFP-NLS transduction efficiency was found to be 60.6%.

SEQUENCE LISTING

This application contains a Sequence Listing in computer readable form amended Dec. 5, 2022, having a size of 5,147 KB. The computer readable form is incorporated herein by reference.

| SEQ ID NO: | Description |
| --- | --- |
| 1 | CM18 |
| 2 | Diphtheria toxin T domain (DT) |
| 3 | GALA |
| 4 | PEA |
| 5 | INF-7 |
| 6 | LAH4 |
| 7 | HGP |
| 8 | H5WYG |
| 9 | HA2 |
| 10 | EB1 |
| 11 | VSVG |
| 12 | Pseudomonas toxin |
| 13 | Melittin |
| 14 | KALA |
| 15 | JST-1 |
| 16 | SP |
| 17 | TAT |
| 18 | Penetratin (Antennapedia) |
| 19 | pVEC |
| 20 | M918 |
| 21 | Pep-1 |
| 22 | Pep-2 |
| 23 | Xentry |
| 24 | Arginine stretch |
| 25 | Transportan |
| 26 | SynB1 |
| 27 | SynB3 |
| 28 | E1a |
| 29 | SV40 T-Ag |
| 30 | c-myc |
| 31 | Op-T-NLS |
| 32 | Vp3 |
| 33 | Nucleoplasmin |
| 34 | Histone 2B NLS |
| 35 | Xenopus N1 |
| 36 | PARR |
| 37 | PDX-1 |
| 38 | QKI-5 |
| 39 | HCDA |
| 40 | H2B |
| 41 | v-Rel |
| 42 | Amida |
| 43 | RanBP3 |
| 44 | Pho4p |
| 45 | LEF-1 |
| 46 | TCF-1 |
| 47 | BDV-P |
| 48 | TR2 |
| 49 | SOX9 |
| 50 | Max |
| 51 | Mitochondrial signal sequence from Tim9 |
| 52 | Mitochondrial signal sequence from Yeast cytochrome c oxidase subunit IV |
| 53 | Mitochondrial signal sequence from 18S rRNA |
| 54 | Peroxisome signal sequence—PTS1 |
| 55 | Nucleolar signal sequence from BIRC5 |
| 56 | Nucleolar signal sequence from RECQL4 |
| 57 | CM18-TAT |
| 58 | CM18-Penetratin |
| 59 | His-CM18-TAT |
| 60 | GFP |
| 61 | TAT-GFP |
| 62 | GFP-NLS |
| 63 | C(LLKK)3C |
| 64 | G(LLKK)3G |
| 65 | PTD4 |
| 66 | TAT-CM18 |
| 67 | TAT-KALA |
| 68 | His-CM18-PTD4 |
| 69 | His-CM18-9Arg |
| 70 | His-CM18-Transportan |
| 71 | His-LAH4-PTD4 |
| 72 | His-C(LLKK)3C-PTD4 |
| 73 | mCherryTM-NLS |
| 74 | Cas9-NLS |
| 75 | crRNA (Example 13.3) |
| 76 | tracrRNA (Example 13.3) |
| 77 | Feldan tracrRNA (Example 13.5, 13.6) |
| 78 | PPIB crRNA (Example 13.5) |
| 79 | Dharmacon tracrRNA (Example 13.5) |
| 80 | HOXB4-WT |
| 81 | His-PTD4 |
| 82 | PTD4-KALA |
| 83 | 9Arg-KALA |
| 84 | Pep1-KALA |
| 85 | Xentry-KALA |
| 86 | SynB3-KALA |
| 87 | VSVG-PTD4 |
| 88 | EB1-PTD4 |
| 89 | JST-PTD4 |
| 90 | CM18-PTD4 |
| 91 | 6Cys-CM18-PTD4 |
| 92 | CM18-L1-PTD4 |
| 93 | CM18-L2-PTD4 |
| 94 | CM18-L3-PTD4 |
| 95 | His-CM18-TAT |
| 96 | His-CM18-PTD4-6Cys |
| 97 | 3His-CM18-PTD4 |
| 98 | 12His-CM18-PTD4 |
| 99 | HA-CM18-PTD4 |
| 100 | 3HA-CM18-PTD4 |
| 101 | CM18-His-PTD4 |
| 102 | His-CM18-PTD4-His |
| 103 | HPRT crRNA (Example 13.6) |
| 104-129 | FSD1-FSD26 |
| 130-137 | FSN1-FSN8 |
| 138-153 | FSD27-FSD42 |
| 154 | Short DNA template |

-continued

| SEQ ID NO: | Description |
|---|---|
| 155 | Cpf1-NLS |
| 156 | GFP coding DNA template |
| 157 | DNMT1 crRNA |
| 158 | LKLWXRXLKXXXXG motif |
| 159 | RRXXAKXA motif |
| 160 | B2M crRNA (Cas9) |
| 161 | B2M exon 2 crRNA-1 (Cpf1) |
| 162 | B2M exon 2 crRNA-2 (Cpf1) |
| 163 | CBLB crRNA |
| 164 | GSK3 crRNA |
| 165 | NKG2A crRNA |
| 166 | B2M crRNA-E |
| 167 | B2M crRNA-J |
| 168 | B2M crRNA-G |
| 169-242 | FSD43-FSD116 |
| 243-10 242 | Computer-generated peptide variants that respect design parameters described herein |

DETAILED DESCRIPTION

Large-scale screening efforts led to the discovery that domain-based peptide shuttle agents, comprising an endosome leakage domain (ELD) operably linked to a cell penetrating domain (CPD), and optionally one or more histidine-rich domains, can increase the transduction efficiency of an independent polypeptide cargo in eukaryotic cells, such that the cargo gains access to the cytosol/nuclear compartment (e.g., see Examples 1-15). Conversely, the above screening efforts also revealed some peptides having no or low polypeptide cargo transduction power, excessive toxicity, and/or other undesirable properties (e.g., poor solubility and/or stability).

Based on these empirical data (both positive and negative), the amino acid sequences and properties of successful, less successful, and failed peptides were compared in order to better understand the physicochemical properties common to the more successful shuttle agents. This comparison involved two main approaches: First, manually stratifying the different screened peptides according to their transduction performance, based on our complied biological characterization data; and second, a more simplified "transduction score" approach, which considered only the transduction efficiency and cellular toxicity of the different peptides, for a given polypeptide cargo and cell line.

For manual stratification, the screened peptides were evaluated individually according to their transduction performance, with due consideration to, for example: their solubility/stability/ease of synthesis; their ability to facilitate escape of endosomally-trapped calcein (e.g., see Example 2); their ability to deliver one or more types of independent polypeptide cargos intracellularly, as evaluated by flow cytometry (e.g., see Examples 3-6 and 8-15) in different types of cells and cell lines (e.g., primary, immortalized, adherent, suspension, etc.) as well as under different transduction protocols; their ability to deliver polypeptide cargos to the cytosol and/or nucleus, as evaluated by fluorescence microscopy (e.g., for fluorescently labelled cargos), increased transcriptional activity (e.g., for transcription factor cargos), or genome editing capabilities (e.g., for nuclease cargos or genome-editing complexes such as CRISPR/Cas9 or CRISPR/Cpf1) (e.g., see Examples 3-6 and 8-15), and toxicity towards different types of cells and cell lines (e.g., primary, immortalized, adherent, suspension, etc.), under different transduction protocols.

For the "transduction score" approach, each peptide was assigned a score corresponding to a given cell line and fluorescently-labelled polypeptide cargo, which combines both transduction efficiency and cellular toxicity data into a single numerical value. The transduction scores were calculated by simply multiplying the highest percentage transduction efficiency observed by flow cytometry for a given peptide, cargo and cell type by the percentage cellular viability for the peptide in the tested cell line. The peptides were then sorted according to their transduction scores as a screening tool to stratify peptides as successful, less successful, or failed shuttle agents.

The above-mentioned manual curation and "transduction score"-based analyses revealed a number of parameters that are generally shared by successful domain-based shuttle agents (e.g. see Example A). These parameters were then successfully used to manually design new peptide shuttle agents having polypeptide cargo transduction activity, which lack and/or are not based on known putative CPDs and/or ELDs (e.g., see Example B). Furthermore, it was observed that peptides satisfying the most number of design parameters had generally the highest transduction scores, while peptides satisfying the least number of design parameters had generally the lowest transduction scores.

The design parameters described herein were further validated by testing a plurality of synthetic peptides whose amino acid sequences were generated using a machine learning algorithm (e.g., see Example C.1), the algorithm having been "trained" using transduction efficiency and cellular toxicity data of domain-based peptides (but not the design parameters described herein). Interestingly, the peptides generated by the machine learning algorithm demonstrating the highest transduction scores were generally peptides that satisfied all of the design parameters described herein, thereby substantiating their use in actively designing and/or predicting the transduction activity of new peptide shuttle agents (e.g., tailored to particular polypeptide cargos and/or types of cells). Furthermore, computer-assisted random peptide sequence generation followed by descriptors filtering was used to generate a list of 10 000 peptide variants that respect nearly all of the design parameters described herein (see Example C.2).

Rationally-designed peptide shuttle agents are shown herein to facilitate escape of an endosomally trapped fluorescent dye, suggesting endosomolytic activity (e.g., see Example D). Furthermore, the ability of rationally-designed peptide shuttle agents to transduce a variety of polypeptide cargos (e.g., fluorescent proteins, transcription factors, antibodies, as well as entire CRISPR-associated genome editing complexes, with or without a DNA template) in a variety of different cell types (both adherent and suspension) is also shown herein (e.g., see Examples E-G).

Rational Design Parameters and Peptide Shuttle Agents

In some aspects, the present description relates to a method for delivering a polypeptide cargo from an extracellular space to the cytosol and/or nucleus of a target eukaryotic cell. The method comprises contacting the target eukaryotic cell with the polypeptide cargo in the presence of a shuttle agent at a concentration sufficient to increase the transduction efficiency of said polypeptide cargo, as compared to in the absence of the shuttle agent. In some aspects, the shuttle agent relates to a peptide that satisfies one or more of the following parameters.

(1) In some embodiments, the shuttle agent is a peptide at least 20 amino acids in length. For example, the peptide may comprise a minimum length of 20, 21, 22, 23, 24, 25, 26, 27, 28, 29, or 30 amino acid residues, and a maximum length of 35, 36, 37, 38, 39, 40, 41, 42, 43, 44, 45, 46, 47, 48, 49, 50, 51, 52, 53, 54, 55, 60, 65, 70, 75, 80, 85, 90, 95, 100, 105, 110, 115, 120, 125, 130, 135, 140, 145, or 150 amino acid residues. In some embodiments, shorter peptides (e.g., in the 20-50 amino acid range) may be particularly advantageous because they may be more easily synthesized and purified by chemical synthesis approaches, which may be more suitable for clinical use (as opposed to recombinant proteins that must be purified from cellular expression systems). While numbers and ranges in the present description are often listed as multiples of 5, the present description should not be so limited. For example, the maximum length described herein should be understood as also encompassing a length of 56, 57, 58 . . . 61, 62, etc., in the present description, and that their non-listing herein is only for the sake of brevity. The same reasoning applies to the % of identities listed herein.

(2) In some embodiments, the peptide shuttle agent comprises an amphipathic alpha-helical motif. As used herein, the expression "alpha-helical motif" or "alpha-helix", unless otherwise specified, refers to a right-handed coiled or spiral conformation (helix) having angle of rotation between consecutive amino acids of 100 degrees and/or an alpha-helix having 3.6 residues per turn. As used herein, the expression "comprises an alpha-helical motif" or "an amphipathic alpha-helical motif" and the like, refers to the three-dimensional conformation that a peptide (or segment of a peptide) of the present description is predicted to adopt when in a biological setting based on the peptide's primary amino acid sequence, regardless of whether the peptide actually adopts that conformation when used in cells as a shuttle agent. Furthermore, the peptides of the present description may comprise one or more alpha-helical motifs in different locations of the peptide. For example, the shuttle agent FSD5 is predicted to adopt an alpha-helix over the entirety of its length (see FIG. 49C), while the shuttle agent FSD18 is predicted to comprise two separate alpha-helices towards the N and C terminal regions of the peptide (see FIG. 49D). In some embodiments, the shuttle agents of the present description are not predicted to comprise a beta-sheet motif, for example as shown in FIGS. 49E and 49F. Methods of predicting the presence of alpha-helices and beta-sheets in proteins and peptides are well known in the art. For example, one such method is based on 3D modeling using PEP-FOLD™, an online resource for de novo peptide structure prediction (http://bioserv.rpbs.univ-paris-diderot.fr/services/PEP-FOLD/) (Lamiable et al., 2016; Shen et al., 2014; Thévenet et al., 2012). Other methods of predicting the presence of alpha-helices in peptides and protein are known and readily available to the skilled person.

As used herein, the expression "amphipathic" refers to a peptide that possesses both hydrophobic and hydrophilic elements (e.g., based on the side chains of the amino acids that comprise the peptide). For example, the expression "amphipathic alpha helix" or "amphipathic alpha-helical motif" refers to a peptide predicted to adopt an alpha-helical motif having a non-polar hydrophobic face and a polar hydrophilic face, based on the properties of the side chains of the amino acids that form the helix.

(3) In some embodiments, peptide shuttle agents of the present description comprise an amphipathic alpha-helical motif having a positively-charged hydrophilic outer face, such as one that is rich in R and/or K residues. As used herein, the expression "positively-charged hydrophilic outer face" refers to the presence of at least three lysine (K) and/or arginine (R) residues clustered to one side of the amphipathic alpha-helical motif, based on alpha-helical wheel projection (e.g., see FIG. 49A, left panel). Such helical wheel projections may be prepared using a variety of programs, such as the online helical wheel projection tool available at: http://rzlab.ucr.edu/scripts/wheel/wheel.cgi. In some embodiments, the amphipathic alpha-helical motif may comprise a positively-charged hydrophilic outer face that comprises: (a) at least two, three, or four adjacent positively-charged K and/or R residues upon helical wheel projection; and/or (b) a segment of six adjacent residues comprising three to five K and/or R residues upon helical wheel projection, based on an alpha helix having angle of rotation between consecutive amino acids of 100 degrees and/or an alpha-helix having 3.6 residues per turn.

In some embodiments, peptide shuttle agents of the present description comprise an amphipathic alpha-helical motif comprising a hydrophobic outer face, the hydrophobic outer face comprising: (a) at least two adjacent L residues upon helical wheel projection; and/or (b) a segment of ten adjacent residues comprising at least five hydrophobic residues selected from: L, I, F, V, W, and M, upon helical wheel projection, based on an alpha helix having angle of rotation between consecutive amino acids of 100 degrees and/or an alpha-helix having 3.6 residues per turn.

(4) In some embodiments, peptide shuttle agents of the present description comprise an amphipathic alpha-helical motif having a highly hydrophobic core composed of spatially adjacent highly hydrophobic residues (e.g., L, I, F, V, W, and/or M). In some embodiments, the highly hydrophobic core may consist of spatially adjacent L, I, F, V, W, and/or M amino acids representing 12 to 50% of the amino acids of the peptide, calculated while excluding any histidine-rich domains (see below), based on an open cylindrical representation of the alpha-helix having 3.6 residues per turn, as shown for example in FIG. 49A, right panel. In some embodiments, the highly hydrophobic core may consist of spatially adjacent L, I, F, V, W, and/or M amino acids representing from 12.5%, 13%, 13.5%, 14%, 14.5%, 15%, 15.5%, 16%, 16.5%, 17%, 17.5%, 18%, 18.5%, 19%, 19.5%, or 20%, to 25%, 30%, 35%, 40%, or 45% of the amino acids of the peptide. More particularly, highly hydrophobic core parameter may be calculated by first arranging the amino acids of the peptide in an opened cylindrical representation, and then delineating an area of contiguous highly hydrophobic residues (L, I, F, V, W, M), as shown in FIG. 49A, right panel. The number of highly hydrophobic residues comprised in this delineated highly hydrophobic core is then divided by the total amino acid length of the peptide, excluding any histidine-rich domains (e.g., N- and/or C-terminal histidine-rich domains). For example, for the peptide shown in FIG. 49A, there are 8 residues in the delineated highly hydrophobic core, and 25 total residues in the peptide (excluding the terminal 12 histidines). Thus, the highly hydrophobic core is 32% (8/25).

(5) Hydrophobic moment relates to a measure of the amphiphilicity of a helix, peptide, or part thereof, calculated from the vector sum of the hydrophobicities of the side chains of the amino acids (Eisenberg et al., 1982). An online tool for calculating the hydrophobic moment of a polypeptide is available from: http://rzlab.ucr.edu/scripts/wheel/wheel.cgi. A high hydrophobic moment indicates strong amphiphilicity, while a low hydrophobic moment indicates poor amphiphilicity. In some embodiments, peptide shuttle agents of the present description may consist of or comprise a peptide or alpha-helical domain having have a hydrophobic moment ($\mu$) of 3.5 to 11. In some embodiments, the shuttle agent may be a peptide comprising an amphipathic alpha-helical motif having a hydrophobic moment between a lower limit of 3.5, 3.6, 3.7, 3.8, 3.9, 4.0, 4.1, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, 6.5, 6.6, 6.7, 6.8, 6.9, 7.0, and an upper limit of 9.5, 9.6, 9.7, 9.8, 9.9, 10.0, 10.1, 10.2, 10.3, 10.4, 10.5, 10.6, 10.7, 10.8, 10.9, or 11.0. In some embodiments, the shuttle agent may be a peptide having a hydrophobic moment between a lower limit of 4.0, 4.1, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, 6.5, 6.6, 6.7, 6.8, 6.9, 7.0, and an upper limit of 9.5, 9.6, 9.7, 9.8, 9.9, 10.0, 10.1, 10.2, 10.3, 10.4, or 10.5. In some embodiments, the hydrophobic moment is calculated excluding any histidine-rich domains that may be present in the peptide.

(6) In some embodiments, peptide shuttle agents of the present description may have a predicted net charge of at least +4 at physiological pH, calculated from the side chains of K, R, D, and E residues. For example, the net charge of the peptide may be at least +5, +6, +7, at least +8, at least +9, at least +10, at least +11, at least +12, at least +13, at least +14, or at least +15 at physiological pH. These positive charges are generally conferred by the greater presence of positively-charged lysine and/or arginine residues, as opposed to negatively charged aspartate and/or glutamate residues.

(7) In some embodiments, peptide shuttle agents of the present description may have a predicted isoelectric point (pI) of 8 to 13, preferably from 10 to 13. Programs and methods for calculating and/or measuring the isoelectric point of a peptide or protein are known in the art. For example, pI may be calculated using the Prot Param software available at: http://web.expasy.org/protparam/

(8) In some embodiments, peptide shuttle agents of the present description may be composed of 35 to 65% of hydrophobic residues (A, C, G, I, L, M, F, P, W, Y, V). In particular embodiments, the peptide shuttle agents may be composed of 36% to 64%, 37% to 63%, 38% to 62%, 39% to 61%, or 40% to 60% of any combination of the amino acids: A, C, G, I, L, M, F, P, W, Y, and V.

(9) In some embodiments, peptide shuttle agents of the present description may be composed of 0 to 30% of neutral hydrophilic residues (N, Q, S, T). In particular embodiments, the peptide shuttle agents may be composed of 1% to 29%, 2% to 28%, 3% to 27%, 4% to 26%, 5% to 25%, 6% to 24%, 7% to 23%, 8% to 22%, 9% to 21%, or 10% to 20% of any combination of the amino acids: N, Q, S, and T.

(10) In some embodiments, peptide shuttle agents of the present description may be composed of 35 to 85% of the amino acids A, L, K and/or R. In particular embodiments, the peptide shuttle agents may be composed of 36% to 80%, 37% to 75%, 38% to 70%, 39% to 65%, or 40% to 60% of any combination of the amino acids: A, L, K, or R.

(11) In some embodiments, peptide shuttle agents of the present description may be composed of 15 to 45% of the amino acids A and/or L, provided there being at least 5% of L in the peptide. In particular embodiments, the peptide shuttle agents may be composed of 15% to 40%, 20% to 40%, 20 to 35%, or 20 to 30% of any combination of the amino acids: A and L, provided there being at least 5% of L in the peptide.

(12) In some embodiments, peptide shuttle agents of the present description may be composed of 20 to 45% of the amino acids K and/or R. In particular embodiments, the peptide shuttle agents may be composed of 20% to 40%, 20 to 35%, or 20 to 30% of any combination of the amino acids: K and R.

(13) In some embodiments, peptide shuttle agents of the present description may be composed of 0 to 10% of the amino acids D and/or E. In particular embodiments, the peptide shuttle agents may be composed of 5 to 10% of any combination of the amino acids: D and E.

(14) In some embodiments, the absolute difference between the percentage of A and/or L and the percentage of K and/or R in the peptide shuttle agent may be less than or equal to 10%. In particular embodiments, the absolute difference between the percentage of A and/or L and the percentage of K and/or R in the peptide shuttle agent may be less than or equal to 9%, 8%, 7%, 6%, or 5%.

(15) In some embodiments, peptide shuttle agents of the present description may be composed of 10% to 45% of the amino acids Q, Y, W, P, I, S, G, V, F, E, D, C, M, N, T, or H (i.e., not A, L, K, or R). In particular embodiments, the peptide shuttle agents may be composed of 15 to 40%, 20% to 35%, or 20% to 30% of any combination of the amino acids: Q, Y, W, P, I, S, G, V, F, E, D, C, M, N, T, and H.

In some embodiments, peptide shuttle agents of the present description respect at least one, at least two, at least three, at least four, at least five, at least six, at least seven, at least eight, at least nine, at least ten, at least eleven, at least twelve, at leave thirteen, at least fourteen, or all of parameters (1) to (15) described herein. In particular embodiments, peptide shuttle agents of the present description respect all of parameters (1) to (3), and at least six, at least seven, at least eight, at least nine, at least ten, at least eleven, or all of parameters (4) to (15) described herein.

In some embodiments, where a peptide shuttle agent of the present description comprises only one histidine-rich domain, the residues of the one histidine-rich domain may be included in the calculation/assessment of parameters (1) to (15) described herein. In some embodiments, where a peptide shuttle agent of the present description comprises more than one histidine-rich domain, only the residues of one of the histidine-rich domains may be included in the calculation/assessment of parameters (1) to (15) described herein. For example, where a peptide shuttle agent of the present description comprises two histidine-rich domains: a first histidine-rich domain towards the N terminus, and a second histidine-rich domain towards the C terminus, only the first histidine-rich domain may be included in the calculation/assessment of parameters (1) to (15) described herein.

In some embodiments, a machine-learning or computer-assisted design approach may be implemented to generate peptides that respect one or more of parameters (1) to (15) described herein. Some parameters, such as parameters (1) and (5)-(15), may be more amenable to implementation in a computer-assisted design approach, while structural parameters, such as parameters (2), (3) and (4), may be more amenable to a manual design approach. Thus, in some embodiments, peptides that respect one or more of parameters (1) to (15) may be generated by combining computer-assisted and manual design approaches. For example, multiple sequence alignment analyses of a plurality of peptides shown herein (and others) to function as effective shuttle agents revealed the presence of some consensus sequences—i.e., commonly found patterns of alternance of hydrophobic, cationic, hydrophilic, alanine and glycine amino acids. The presence of these consensus sequences are likely to give rise to structural parameters (2), (3) and (4) being respected (i.e., amphipathic alpha-helix formation, a positively-charged face, and a highly hydrophobic core of 12%-50%). Thus, these and other consensus sequences may be employed in machine-learning and/or computer-assisted design approaches to generate peptides that respect one or of parameters (1)-(15).

Accordingly, in some embodiments, peptide shuttle agents described herein may comprise or consist of the amino acid sequence of:

(a) [X1]-[X2]-[linker]-[X3]-[X4]        (Formula 1);

(b) [X1]-[X2]-[linker]-[X4]-[X3]        (Formula 2);

(c) [X2]-[X1]-[linker]-[X3]-[X4]        (Formula 3);

(d) [X2]-[X1]-[linker]-[X4]-[X3]        (Formula 4);

(e) [X3]-[X4]-[linker]-[X1]-[X2]        (Formula 5);

(f) [X3]-[X4]-[linker]-[X2]-[X1]        (Formula 6);

(g) [X4]-[X3]-[linker]-[X1]-[X2]        (Formula 7); or (h) [X4]-[X3]-[linker]-[X2]-[X1]        (Formula 8), wherein:
[X1] is selected from: 2[φ]-1[+]-2[φ]-1[ζ]-1[+]-; 2[φ]-1[+]-2[φ]-2[+]-; 1[+]-1[φ]-1[+]-2[φ]-1[ζ]-1[+]-; and 1[+]-1[φ]-1[+]-2[φ]-2[+]-;

[X2] is selected from: -2[φ]-1[+]-2[φ]-2[ζ]-; -2[φ]-1[+]-2[φ]-2[+]-; -2[φ]-1[+]-2[φ]-1[+]-1[ζ]-; -2[φ]-1[+]-2[φ]-1[ζ]-1[+]-; -2[φ]-2[+]-1[φ]-2[+]-; -2[φ]-2[+]-1[φ]-2[ζ]-; -2[φ]-2[+]-1[φ]-1[+]-1[ζ]-; and -2[φ]-2[+]-1[φ]-1[ζ]-1[+]-;

[X3] is selected from: -4[+]-A-; -3[+]-G-A-; -3[+]-A-A-; -2[+]-1[φ]-1[+]-A-; -2[+]-1[φ]-G-A-; -2[+]-1[φ]-A-A-; or -2[+]-A-1[+]-A; -2[+]-A-G-A; -2[+]-A-A-A-; -1[φ]-3[+]-A-1; -1[φ]-2[+]-G-A-; -1[φ]-2[+]-A-A-; -1[φ]-1[+]-1[φ]-1[+]-A; -1[φ]-1[+]-1[φ]-G-A; -1[φ]-1[+]-1[φ]-A-A; -1[φ]-1[+]-A-1[+]-A; -1[φ]- 1[+]-A-G-A; -1[φ]-1[+]-A-A-A; -A-1[+]-A-1[+]-A; -A-1[+]-A-G-A; and -A-1[+]-A-A-A;

[X4] is selected from: -1[ζ]-2A-1[+]-A; -1[ζ]-2A-2[+]; -1[+]-2A-1[+]-A; -1[ζ]-2A-1[+]-1[ζ]-A-1[+]; -1[ζ]-A-1[ζ]-A-1[+]; -2[+]-A-2[+]; -2[+]-A-1[+]-A; -2[+]-A-1[+]-1[ζ]-A-1[+]; -2[+]-1[ζ]-A- 1[+]; -1[+]-1[ζ]-A-1[+]-A; -1[+]-1[ζ]-A-2[+]; -1[+]-1[ζ]-A-1[+]-1[ζ]-A-1[+]; -1[+]-2[ζ]-A-1[+]; -1[+]-2[ζ]-2[+]; -1[+]-2[ζ]-1[+]-A; -1[+]-2[ζ]-1[+]-1[ζ]-A-1[+]; -1[+]-2[ζ]-1[ζ]-A-1[+]; -3[ζ]-2[+]; -3[ζ]-1[+]-A; -3[ζ]-1[+]-1[ζ]-A-1[+]; -1[ζ]-2A-1[+]-A; -1[ζ]-2A-2[+]; -1[ζ]-2A-1[+]-1[ζ]-A-1[+]; -2[+]-A-1[+]-A; -2[+]-1[ζ]-1[+]-A; -1[+]-1[ζ]-A-1[+]-A; -1[+]-1[ζ]-2A-1[+]-1[ζ]-A-1[+]; and -1[ζ]-A-1[ζ]-A-1[+]; and

[linker] is selected from: -Gn-; -Sn-; -(GnSn)n-; -(GnSn)nGn-; -(GnSn)nSn-; -(GnSn)nGn(GnSn)n-; and -(GnSn)nSn(GnSn)n-;

wherein: [φ] is an amino acid which is: Leu, Phe, Trp, Ile, Met, Tyr, or Val; [+] is an amino acid which is: Lys or Arg; [ζ] is an amino acid which is: Gln, Asn, Thr, or Ser; A is the amino acid Ala; G is the amino acid Gly; S is the amino acid Ser; and n is an integer from 1 to 20, 1 to 19, 1 to 18, 1 to 17, 1 to 16, 1 to 15, 1 to 14, 1 to 13, 1 to 12, 1 to 11, 1 to 101 to 9, 1 to 8, 1 to 7, 1 to 6, 1 to 5, 1 to 1 to 4, or 1 to 3.

In some embodiments, peptide shuttle agents of the present description may comprise or consist of any one of the amino acid sequences of SEQ ID NOs: 104, 105, 107, 108, 110-131, 133-135, 138, 140, 142, 145, 148, 151, 152, 169-242, and 243-10 242. In some embodiments, peptide shuttle agents of the present description may comprise the amino acid sequence motifs of SEQ ID NOs: 158 and/or 159, which were found in each of peptides FSD5, FSD16, FSD18, FSD19, FSD20, FSD22, and FSD23. In some embodiments, peptide shuttle agents of the present description may comprise the amino acid sequence motif of SEQ ID NO: 158 operably linked to the amino acid sequence motif of SEQ ID NO: 159. In some embodiments, peptide shuttle agents of the present description may comprise or consist of a peptide which is at least 50%, 55%, 60%, 65%, 70%, 75%, 80%, 85%, 90%, or 95% identical to the amino acid sequence of any one of SEQ ID NOs: 104, 105, 107, 108, 110-131, 133-135, 138, 140, 142, 145, 148, 151, 152, 169-242, and 243-10 242, or a functional variant of any one of SEQ ID NOs: 104, 105, 107, 108, 110-131, 133-135, 138, 140, 142, 145, 148, 151, 152, 169-242, and 243-10 242. As used herein, a "functional variant" refers to a peptide having polypeptide cargo transduction activity, which differs from the reference peptide by one or more conservative amino acid substitutions. As used herein, a "conservative amino acid substitution" is one in which one amino acid residue is replaced with another amino acid residue having a similar side chain. Families of amino acid residues having similar side chains have been well defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

In some embodiments, peptide shuttle agents of the present description may comprise or consist of the amino acid sequence of any one of SEQ ID NOs: 57-59, 66-72, or 82-102, or a functional variant thereof having at least 65%, 66%, 67%, 68%, 69%, 70%, 71%, 72%, 73%, 74%, 75%, 76%, 77%, 78%, 79%, 80%, 81% 82%, 83%, 84%, 85%, 86%, 87%, 88%, 89%, 90%, 91%, 92%, 93%, 94%, or 95% identity to any one of SEQ ID NOs: 57-59, 66-72, or 82-102. In some embodiments, peptide shuttle agents of the present description do not comprise one or more of the amino acid sequences of any one of SEQ ID NOs: 57-59, 66-72, or 82-102.

In some embodiments, shuttle agents of the present description may comprise oligomers (e.g., dimers, trimers, etc.) of peptides described herein. Such oligomers may be constructed by covalently binding the same or different types of shuttle agent monomers (e.g., using disulfide bridges to link cysteine residues introduced into the monomer sequences). In some embodiments, shuttle agents of the present description may comprise an N-terminal and/or a C-terminal cysteine residue.

Histidine-Rich Domains

In some embodiments, peptide shuttle agents of the present description may further comprise one or more histidine-rich domains. In some embodiments, the histidine-rich domain may be a stretch of at least 2, at least 3, at least 4, at least 5, or at least 6 amino acids comprising at least 30%, at least 35%, at least 40%, at least 45%, at least 50%, at least 55%, at least 60%, at least 65%, at least 70%, at least 75%, at least 80%, at least 85%, or at least 90% histidine residues. In some embodiments, the histidine-rich domain may comprise at least 2, at least 3, at least 4 at least 5, at least 6, at least 7, at least 8, or at least 9 consecutive histidine residues. Without being bound by theory, the histidine-rich domain in the shuttle agent may act as a proton sponge in the endosome through protonation of their imidazole groups under acidic conditions of the endosomes, providing another mechanism of endosomal membrane destabilization and thus further facilitating the ability of endosomally-trapped cargos to gain access to the cytosol. In some embodiments, the histidine-rich domain may be located at or towards the N and/or C terminus of the peptide shuttle agent.

Linkers

In some embodiments, peptide shuttle agents of the present description may comprise one or more suitable linkers (e.g., flexible polypeptide linkers). In some embodiments, such linkers may separate two or more amphipathic alpha-helical motifs (e.g., see the shuttle agent FSD18 in FIG. 49D). In some embodiments, linkers can be used to separate two more domains (CPDs, ELDs, or histidine-rich domains) from one another. In some embodiments, linkers may be formed by adding sequences of small hydrophobic amino acids without rotatory potential (such as glycine) and polar serine residues that confer stability and flexibility. Linkers may be soft and allow the domains of the shuttle agents to move. In some embodiments, prolines may be avoided since they can add significant conformational rigidity. In some embodiments, the linkers may be serine/glycine-rich linkers (e.g., GGS, GGSGGGS (SEQ ID NO: 10 243), GGSGGGSGGS (SEQ ID NO: 10 244), or the like). In some embodiments, the use shuttle agents comprising a suitable linker may be advantageous for delivering an independent polypeptide cargo to suspension cells, rather than to adherent cells. In some embodiments, the linker may comprise or consist of: -Gn-; -Sn-; -(GnSn)n-; -(GnSn)nGn-; -(GnSn)nSn-; -(GnSn)nGn(GnSn)n-; or -(GnSn)nSn(GnSn) n-, wherein G is the amino acid Gly; S is the amino acid Ser; and n is an integer from 1 to 5.

Endosome Leakage Domains (ELDs)

In some aspects, peptide shuttle agents of the present description may comprise an endosome leakage domain (ELD) for facilitating endosome escape and access to the cytoplasmic compartment. As used herein, the expression "endosome leakage domain" refers to a sequence of amino acids which confers the ability of endosomally-trapped macromolecules to gain access to the cytoplasmic compartment. Without being bound by theory, endosome leakage domains are short sequences (often derived from viral or bacterial peptides), which are believed to induce destabilization of the endosomal membrane and liberation of the endosome contents into the cytoplasm. As used herein, the expression "endosomolytic peptide" is intended to refer to this general class of peptides having endosomal membrane-destabilizing properties. Accordingly, in some embodiments, synthetic peptide or polypeptide-based shuttle agents of the present description may comprise an ELD which is an endosomolytic peptide. The activity of such peptides may be assessed for example using the calcein endosome escape assays described in Example 2.

In some embodiments, the ELD may be a peptide that disrupts membranes at acidic pH, such as pH-dependent membrane active peptide (PMAP) or a pH-dependent lytic peptide. For example, the peptides GALA and INF-7 are amphiphilic peptides that form alpha helixes when a drop in pH modifies the charge of the amino acids which they contain. More particularly, without being bound by theory, it is suggested that ELDs such as GALA induce endosomal leakage by forming pores and flip-flop of membrane lipids following conformational change due to a decrease in pH (Kakudo, Chaki et al., 2004, Li, Nicol et al., 2004). In contrast, it is suggested that ELDs such as INF-7 induce endosomal leakage by accumulating in and destabilizing the endosomal membrane (El-Sayed, Futaki et al., 2009). Accordingly, in the course of endosome maturation, the concomitant decline in pH causes a change in the conformation of the peptide and this destabilizes the endosome membrane leading to the liberation of the endosome contents. The same principle is thought to apply to the toxin A of *Pseudomonas* (Varkouhi, Scholte et al., 2011). Following a decline in pH, the conformation of the domain of translocation of the toxin changes, allowing its insertion into the endosome membrane where it forms pores (London 1992, O'Keefe 1992). This eventually favors endosome destabilization and translocation of the complex outside of the endosome. The above described ELDs are encompassed within the ELDs of the present description, as well as other mechanisms of endosome leakage whose mechanisms of action may be less well defined.

In some embodiments, the ELD may be an antimicrobial peptide (AMP) such as a linear cationic alpha-helical antimicrobial peptide (AMP). These peptides play a key role in the innate immune response due to their ability to strongly interact with bacterial membranes. Without being bound by theory, these peptides are thought to assume a disordered state in aqueous solution, but adopt an alpha-helical secondary structure in hydrophobic environments. The latter conformation thought to contribute to their typical concentration-dependent membrane-disrupting properties. When accumulated in endosomes at certain concentrations, some antimicrobial peptides may induce endosomal leakage.

In some embodiments, the ELD may be an antimicrobial peptide (AMP) such as Cecropin-A/Melittin hybrid (CM series) peptide. Such peptides are thought to be among the smallest and most effective AMP-derived peptides with membrane-disrupting ability. Cecropins are a family of antimicrobial peptides with membrane-perturbing abilities against both Gram-positive and Gram-negative bacteria. Cecropin A (CA), the first identified antibacterial peptide, is composed of 37 amino acids with a linear structure. Melittin (M), a peptide of 26 amino acids, is a cell membrane lytic factor found in bee venom. Cecropin-melittin hybrid peptides have been shown to produce short efficient antibiotic peptides without cytotoxicity for eukaryotic cells (i.e., non-hemolytic), a desirable property in any antibacterial agent. These chimeric peptides were constructed from various combinations of the hydrophilic N-terminal domain of Cecropin A with the hydrophobic N-terminal domain of Melittin, and have been tested on bacterial model systems. Two 26-mers, CA(1-13)M(1-13) and CA(1-8) M(1-18) (Boman et al., 1989), have been shown to demonstrate a wider spectrum and improved potency of natural Cecropin A without the cytotoxic effects of melittin.

In an effort to produce shorter CM series peptides, the authors of Andreu et al., 1992 constructed hybrid peptides such as the 26-mer (CA(1-8)M(1-18)), and compared them with a 20-mer (CA(1-8)M(1-12)), a 18-mer (CA(1-8)M(1-10)) and six 15-mers ((CA(1-7)M(1-8), CA(1-7)M(2-9), CA(1-7)M(3-10), CA(1-7)M(4-11), CA(1-7)M(5-12), and CA(1-7)M(6-13)). The 20 and 18-mers maintained similar activity comparatively to CA(1-8)M(1-18). Among the six 15-mers, CA(1-7)M(1-8) showed low antibacterial activity, but the other five showed similar antibiotic potency compared to the 26-mer without hemolytic effect. Accordingly, in some embodiments, synthetic peptide or polypeptide-based shuttle agents of the present description may comprise an ELD which is or is from CM series peptide variants, such as those described above.

In some embodiments, the ELD may be the CM series peptide CM18 composed of residues 1-7 of Cecropin-A (KWKLFKKIGAVLKVLTTG) fused to residues 2-12 of Melittin (YGRKKRRQRRR), [C(1-7)M(2-12)]. When fused to the cell penetrating peptide TAT, CM18 was shown to independently cross the plasma membrane and destabilize the endosomal membrane, allowing some endosomally-trapped cargos to be released to the cytosol (Salomone et al., 2012). However, the use of a CM18-TAT11 peptide fused to a fluorophore (atto-633) in some of the authors' experiments, raises uncertainty as to the contribution of the peptide versus the fluorophore, as the use of fluorophores themselves have been shown to contribute to endosomolysis—e.g., via photochemical disruption of the endosomal membrane (Erazo-Oliveras et al., 2014).

In some embodiments, the ELD may be CM18 having the amino acid sequence of SEQ ID NO: 1, or a variant thereof having at least 70%, 71%, 72%, 73%, 74%, 75%, 76%, 77%, 78%, 79%, 80%, 81%, 82%, 83%, 84%, 85%, 86%, 87%, 88%, 89%, 85%, 90%, 91%, 92%, 93%, 94%, or 95% identity to SEQ ID NO: 1 and having endosomolytic activity.

In some embodiments, the ELD may be a peptide derived from the N terminus of the HA2 subunit of influenza hemagglutinin (HA), which may also cause endosomal membrane destabilization when accumulated in the endosome.

In some embodiments, synthetic peptide or polypeptide-based shuttle agents of the present description may comprise an ELD which is or is from an ELD set forth in Table I, or a variant thereof having endosome escape activity and/or pH-dependent membrane disrupting activity.

TABLE I

Examples of endosome leakage domains

| Name | Amino acid sequence | SEQ ID NO: | Reference(s) |
|---|---|---|---|
| CM18 | KWKLFKKIGAVLKVLTTG | 1 | (Salomone, Cardarelli et al., 2012) |
| Diphtheria toxin T domain (DT) | VGSSLSCINLDWDVIRDKTKTKIESLKEHGPIKNK MSESPNKTVSEEKAKQYLEEFHQTALEHPELSEL KTVIGINPVFAGANYMWAVNVAQVIDSETADNL EKTTAALSILPGIGSVMGIADGAVHHNTEEIVAQSI ALSSLMVAQAIPLVGELVDIGFAAYNFVESIIN LFQVVHNSYNRPAYSPG | 2 | (Uherek, Fominaya et al., 1998, Glover, Ng et al., 2009) |
| GALA | WEAALAEALAEALAEHLAEALAEALEALAA | 3 | (Parente, Nir et al., 1990) (Li, Nicol et al., 2004) |
| PEA | VLAGNPAKHDLDIKPTVISHRLHFPEGGSLAALTA HQACHLPLETFTRHRQPRGWEQLEQCGYPVQRL VALYLAARLSWNQVDQVIRNALASPGSGG DLGEAIREQPEQARLALT | 4 | (Fominaya and Wels 1996) |
| INF-7 | GLFEAIEGFIENGWEGMIDGWYGC | 5 | (El-Sayed, Futaki et al., 2009) |
| LAH4 | KKALLALALHHLAHLALHLALALKKA | 6 | (Kichler, Mason et al., 2006) Kichler et al., 2003 |
| HGP | LLGRRGWEVLKYWWNLLQYWSQEL | 7 | Kwon et al., 2010 |
| H5WYG | GLFHAIAHFIHGGWHGLIHGWYG | 8 | (Midoux, Kichler et al., 1998) |
| HA2 | GLFGAIAGFIENGWEGMIDGWYG | 9 | (Lorieau, Louis et al., 2010) |
| EB1 | LIRLWSHLIHIWFQNRRLKWKKK | 10 | (Amand, Norden et al., 2012) |
| VSVG | KFTIVFPHNQKGNWKNVPSNYHYCP | 11 | (Schuster, Wu et al., 1999) |
| Pseudomonas toxin | EGGSLAALTAHQACHLPLETFTRHRQPRGWEQL EQCGYPVQRLVALYLAARLSWNQVDQVIRNALAS PGSGGDLGEAIREQPEQARLALTLAAAESERFVR QGTGNDEAGAANAD | 12 | (Fominaya, Uherek et al., 1998) |
| Melittin | GIGAVLKVLTTGLPALISWIKRKRQQ | 13 | Tan, Chen et al., 2012) |
| KALA | WEAKLAKALAKALAKHLAKALAKALKACEA | 14 | (Wyman, Nicol et at, 1997) |
| JST-1 | GLFEALLELLESLWELLLEA | 15 | (Gottschalk, Sparrow et al., 1996) |
| C(LLKK)$_3$C | CLLKKLLKKLLKKC | 63 | (Luan et al., 2014) |
| G(LLKK)$_3$G | GLLKKLLKKLLKKG | 64 | (Luan et al., 2014) |

In some embodiments, shuttle agents of the present description may comprise one or more ELD or type of ELD. More particularly, they can comprise at least 2, at least 3, at least 4, at least 5, or more ELDs. In some embodiments, the shuttle agents can comprise between 1 and 10 ELDs, between 1 and 9 ELDs, between 1 and 8 ELDs, between 1 and 7 ELDs, between 1 and 6 ELDs, between 1 and 5 ELDs, between 1 and 4 ELDs, between 1 and 3 ELDs, etc.

In some embodiments, the order or placement of the ELD relative to the other domains (CPD, histidine-rich domains) within the shuttle agents of the present description may be varied provided the shuttling ability of the shuttle agent is retained.

In some embodiments, the ELD may be a variant or fragment of any one those listed in Table I, and having endosomolytic activity. In some embodiments, the ELD may comprise or consist of the amino acid sequence of any one of SEQ ID NOs: 1-15, 63, or 64, or a sequence which is at least 70%, 71%, 72%, 73%, 74%, 75%, 76%, 77%, 78%, 79%, 80%, 81%, 82%, 83%, 84%, 85%, 86%, 87%, 88%, 89%, 85%, 90%, 91%, 92%, 93%, 94%, or 95% identical to any one of SEQ ID NOs: 1-15, 63, or 64, and having endosomolytic activity.

In some embodiments, shuttle agents of the present description do not comprise one or more of the amino acid sequence of any one of SEQ ID NOs: 1-15, 63, or 64.

Cell Penetration Domains (CPDs)

In some aspects, the shuttle agents of the present description may comprise a cell penetration domain (CPD). As used herein, the expression "cell penetration domain" refers to a sequence of amino acids which confers the ability of a macromolecule (e.g., peptide or protein) containing the CPD to be transduced into a cell.

In some embodiments, the CPD may be (or may be from) a cell-penetrating peptide or the protein transduction domain of a cell-penetrating peptide. Cell-penetrating peptides can serve as carriers to successfully deliver a variety of cargos intracellularly (e.g., polynucleotides, polypeptides, small molecule compounds or other macromolecules/compounds that are otherwise membrane-impermeable). Cell-penetrating peptides often include short peptides rich in basic amino acids that, once fused (or otherwise operably linked) to a macromolecule, mediate its internalization inside cells (Shaw, Catchpole et al., 2008). The first cell-penetrating peptide was identified by analyzing the cell penetration ability of the HIV-1 trans-activator of transcription (Tat) protein (Green and Loewenstein 1988, Vives, Brodin et al., 1997). This protein contains a short hydrophilic amino acid sequence, named "TAT", which promotes its insertion within the plasma membrane and the formation of pores. Since this discovery, many other cell-penetrating peptides have been described. In this regard, in some embodiments, the CPD can be a cell-penetrating peptide as listed in Table II, or a variant thereof having cell-penetrating activity.

TABLE II

Examples of cell-penetrating peptides

| Name | Amino acid sequence | SEQ ID NO: | Reference(s) |
|---|---|---|---|
| SP | AAVALLPAVLLALLAP | 16 | (Mahlum, Mandal et al., 2007) |
| TAT | YGRKKRRQRRR | 17 | (Green and Loewenstein 1988, Fawell, Seery et al., 1994, Vives, Brodin et al., 1997) |
| Penetratin (Antennapedia) | RQIKIWFQNRRMKWKK | 18 | (Perez, Joliot et al., 1992) |
| pVEC | LLIILRRRIRKQAHAHSK | 19 | (Elmquist, Lindgren et al., 2001) |
| M918 | MVTVLFRRLRIRRACGPPRVRV | 20 | (El-Andaloussi, Johansson et al., 2007) |
| Pep-1 | KETWWETWWTEWSQPKKKRKV | 21 | (Morris, Depollier et al., 2001) |
| Pep-2 | KETWFETWFTEWSQPKKKRKV | 22 | (Morris, Chaloin et al., 2004) |
| Xentry | LCLRPVG | 23 | (Montrose, Yang et al., 2013) |
| Arginine stretch | RRRRRRRR | 24 | (Zhou, Wu et al., 2009) |
| Transportan | WTLNSAGYLLGKINLKALAALAKKIL | 25 | (Hallbrink, Floren et al., 2001) |
| SynB1 | RGGRLSYSRRRFSTSTGR | 26 | (Drin, Cottin et al., 2003) |
| SynB3 | RRLSYSRRRF | 27 | (Drin, Cottin et al., 2003) |
| PTD4 | YARAAARQARA | 65 | (Ho et al, 2001) |

Without being bound by theory, cell-penetrating peptides are thought to interact with the cell plasma membrane before crossing by pinocytosis or endocytosis. In the case of the TAT peptide, its hydrophilic nature and charge are thought to promote its insertion within the plasma membrane and the formation of a pore (Herce and Garcia 2007). Alpha helix motifs within hydrophobic peptides (such as SP) are also thought to form pores within plasma membranes (Veach, Liu et al., 2004).

In some embodiments, shuttle agents of the present description may comprise one or more CPD or type of CPD. More particularly, they may comprise at least 2, at least 3, at least 4, or at least 5 or more CPDs. In some embodiments, the shuttle agents can comprise between 1 and 10 CPDs, between 1 and 6 CPDs, between 1 and 5 CPDs, between 1 and 4 CPDs, between 1 and 3 CPDs, etc.

In some embodiments, the CPD may be TAT having the amino acid sequence of SEQ ID NO: 17, or a variant thereof having at least 70%, 71%, 72%, 73%, 74%, 75%, 76%, 77%, 78%, 79%, 80%, 81% 82%, 83%, 84%, 85%, 86%, 87%, 88%, 89%, 90%, 91%, 92%, 93%, 94%, or 95% identity to SEQ ID NO: 17 and having cell penetrating activity; or Penetratin having the amino acid sequence of SEQ ID NO: 18, or a variant thereof having at least 70%, 71%, 72%, 73%, 74%, 75%, 76%, 77%, 78%, 79%, 80%, 81% 82%, 83%, 84%, 85%, 86%, 87%, 88%, 89%, 85%, 86%, 87%, 88%, 89%, 90%, 91%, 92%, 93%, 94%, or 95% identity to SEQ ID NO: 18 and having cell penetrating activity.

In some embodiments, the CPD may be PTD4 having the amino acid sequence of SEQ ID NO: 65, or a variant thereof having at least 70%, 71%, 72%, 73%, 74%, 75%, 76%, 77%, 78%, 79%, 80%, 81% 82%, 83%, 84%, 85%, 86%, 87%, 88%, 89%, 90%, 91%, 92%, 93%, 94%, or 95% identity to SEQ ID NO: 65.

In some embodiments, the order or placement of the CPD relative to the other domains (ELD, histidine-rich domains) within the shuttle agents of the present description may be varied provided the shuttling ability of the shuttle agent is retained.

In some embodiments, the CPD may be a variant or fragment of any one those listed in Table II, and having cell penetrating activity. In some embodiments, the CPD may comprise or consist of the amino acid sequence of any one of SEQ ID NOs: 16-27 or 65, or a sequence which is at least 70%, 71%, 72%, 73%, 74%, 75%, 76%, 77%, 78%, 79%, 80%, 81%, 82%, 83%, 84%, 85%, 86%, 87%, 88%, 89%, 85%, 90%, 91%, 92%, 93%, 94%, or 95% identical to any one of SEQ ID NOs: 16-27 or 65, and having cell penetrating activity.

In some embodiments, shuttle agents of the present description do not comprise any one of the amino acid sequences of SEQ ID NOs: 16-27 or 65.

Cargos

In some aspects, peptide shuttle agents of the present description may be useful for delivering a polypeptide cargo (e.g., an independent polypeptide cargo) from an extracellular space to the cytosol and/or nucleus of a target eukaryotic cell, wherein the synthetic peptide shuttle agent is used at a concentration sufficient to increase the transduction efficiency of said polypeptide cargo, as compared to in the absence of said synthetic peptide shuttle agent. In some embodiments, the polypeptide cargo may be fused to one or more CPDs to further facilitate intracellular delivery. In some embodiments, the CPD fused to the polypeptide cargo may be the same or different from a CPD that may be present in the shuttle agent of the present description. Such fusion proteins may be constructed using standard recombinant technology. In some embodiments, the independent polypeptide cargo may be fused, complexed with, or covalently bound to a second biologically active cargo (e.g., a biologically active polypeptide or compound). Alternatively or simultaneously, the polypeptide cargo may comprise a subcellular targeting domain.

In some embodiments, the polypeptide cargo must be delivered to the nucleus for it to carry out its intended biological effect. One such example is when the cargo is a polypeptide intended for nuclear delivery (e.g., a transcription factor). In this regard, studies on the mechanisms of translocation of viral DNA have led to the identification of nuclear localization signals (NLSs). The NLS sequences are recognized by proteins (importins a and p), which act as transporters and mediators of translocation across the nuclear envelope. NLSs are generally enriched in charged amino acids such as arginine, histidine, and lysine, conferring a positive charge which is partially responsible for their recognition by importins. Accordingly, in some embodiments, the polypeptide cargo may comprise an NLS for facilitating nuclear delivery, such as one or more of the NLSs as listed in Table III, or a variant thereof having nuclear targeting activity. Of course, it is understood that, in certain embodiments, the polypeptide cargo may comprise its natural NLS.

TABLE III

Nuclear localizaion signals

| Name | Amino acid sequence | SEQ ID NO: | Reference(s) |
|---|---|---|---|
| E1a | KRPRP | 28 | (Kohler, Gorlich et al., 2001) |
| SV40 T-Ag | PKKKRKV | 29 | (Lanford, Kanda et al., 1986) |
| c-myc | PAAKRVKLD | 30 | (Makkerh, Dingwall et al., 1996) |
| Op-T-NLS | SSDDEATADSQHAAPPKKKRKV | 31 | (Chan and Jans 1999) |
| Vp3 | KKKRK | 32 | (Nakanishi, Shum et al., 2002) |
| Nucleoplasmin | KRPAATKKAGQAKKKK | 33 | (Fanara, Hodel et al., 2000) |
| Histone 2B NLS | DGKKRKRSRK | 34 | (Moreland, Langevin et al., 1987) |
| Xenopus N1 | VRKKRKTEEESPLKDKDAKKSKQE | 35 | (Kleinschmidt and Seiter 1988) |
| PARP | KRKGDEVDGVDECAKKSKK | 36 | (Schreiber, Molinete et al., 1992) |
| PDX-1 | RRMKWKK | 37 | (Moede, Leibiger et al., 1999) |
| QKI-5 | RVHPYQR | 38 | (Wu, Zhou et al., 1999) |
| HCDA | KRPACTLKPECVQQLLVCSQEAKK | 39 | (Somasekaram, Jarmuz et al., 1999) |
| H2B | GKKRSKA | 40 | (Moreland, Langevin et al., 1987) |

TABLE III-continued

Nuclear localizaion signals

| Name | Amino acid sequence | SEQ ID NO: | Reference(s) |
|---|---|---|---|
| v-Rel | KAKRQR | 41 | (Gilmore and Temin 1988) |
| Amida | RKRRR | 42 | (Irie, Yamagata et al., 2000) |
| RanBP3 | PPVKRERTS | 43 | (Welch, Franke et al., 1999) |
| Pho4p | PYLNKRKGKP | 44 | (Welch, Franke et al., 1999) |
| LEF-1 | KKKKRKREK | 45 | (Prieve and Waterman 1999) |
| TCF-1 | KKKRRSREK | 46 | (Prieve and Waterman 1999) |
| BDV-P | PRPRKIPR | 47 | (Shoya, Kobayashi et al., 1998) |
| TR2 | KDCVINKHHRNRCQYCRLQR | 48 | (Yu, Lee et al., 1998) |
| SOX9 | PRRRK | 49 | (Sudbeck and Scherer 1997) |
| Max | PQSRKKLR | 50 | (Kato, Lee et al., 1992) |

Once delivered to the cytoplasm, recombinant proteins are exposed to protein trafficking system of eukaryotic cells. Indeed, all proteins are synthetized in the cell's cytoplasm and are then redistributed to their final subcellular localization by a system of transport based on small amino acid sequences recognized by shuttle proteins (Karniely and Pines 2005, Stojanovski, Bohnert et al., 2012). In addition to NLSs, other localization sequences can mediate subcellular targeting to various organelles following intracellular delivery of the polypeptide cargos of the present description. Accordingly, in some embodiments, polypeptide cargos of the present description may comprise a subcellular localization signal for facilitating delivery of the shuttle agent and cargo to specific organelles, such as one or more of the sequences as listed in Table IV, or a variant thereof having corresponding subcellular targeting activity.

the expression "biologically active" refers to the ability of a compound to mediate a structural, regulatory, and/or biochemical function when introduced in a target cell.

In some embodiments, the cargo may be a recombinant polypeptide intended for nuclear delivery, such as a transcription factor. In some embodiments, the transcription factor can be HOXB4 (Lu, Feng et al., 2007), NUP98-HOXA9 (Takeda, Goolsby et al., 2006), Oct3/4, Sox2, Sox9, Klf4, c-Myc (Takahashi and Yamanaka 2006), MyoD (Sung, Mun et al., 2013), Pdx1, Ngn3 and MafA (Akinci, Banga et al., 2012), Blimp-1 (Lin, Chou et al., 2013), Eomes, T-bet (Gordon, Chaix et al., 2012), FOXO3A (Warr, Binnewies et al., 2013), NF-YA (Dolfini, Minuzzo et al., 2012), SALL4 (Aguila, Liao et al., 2011), ISL1 (Fonoudi, Yeganeh et al., 2013), FoxA1 (Tan, Xie et al., 2010), Nanog, Esrrb, Lin28 (Buganim et al., 2014), HIF1-alpha (Lord-Dufour et al.,

TABLE IV

Subcellular localization signals

| Name | Amino acid sequence | SEQ ID NO: | Reference(s) |
|---|---|---|---|
| Mitochondrial signal sequence from Tim9 | NLVERCFTD | 51 | (Milenkovic, Ramming et al., 2009) |
| Mitochondrial signal sequence from Yeast cytochrome c oxidase subunit IV | MLSLRQSIRFFK | 52 | (Hurt, Pesold-Hurt et al., 1985) |
| Mitochondrial signal sequence from 18S rRNA | MLISRCKWSRFPGNQR | 53 | (Bejarano and Gonzalez 1999) |
| Peroxisome signal sequence-PTS1 | SKL | 54 | (Gould, Keller et al., 1989) |
| Nucleolar signal sequence from BIRC5 | MQRKPTIRRKNLRLRRK | 55 | (Scott, Boisvert et al., 2010) |
| Nucleolar signal sequence from RECQL4 | KQAWKQKWRKK | 56 | (Scott, Boisvert et al., 2010) |

In some embodiments, the cargo can be a biologically active compound such as a biologically active (recombinant) polypeptide (e.g., a transcription factor, a cytokine, or a nuclease) intended for intracellular delivery. As used herein, 2009), Hlf, Runx1t1, Pbx1, Lmo2, Zfp37, Prdm5 (Riddell et al., 2014), or Bcl-6 (Ichii, Sakamoto et al., 2004).

In some embodiments, the cargo may be a recombinant polypeptide intended for nuclear delivery, such as a nuclease useful for genome editing technologies. In some embodiments, the nuclease may be an RNA-guided endonuclease, a CRISPR endonuclease, a type I CRISPR endonuclease, a type II CRISPR endonuclease, a type III CRISPR endonuclease, a type IV CRISPR endonuclease, a type V CRISPR endonuclease, a type VI CRISPR endonuclease, CRISPR associated protein 9 (Cas9), Cpf1 (Zetsche et al., 2015), CasX and/or CasY (Burstein et al., 2016) a zinc-finger nuclease (ZFN), a Transcription activator-like effector nuclease (TALEN) (Cox et al., 2015), a homing endonuclease, a meganuclease, a DNA-guided nuclease such as *Natronobacterium gregoryi* Argonaute (NgAgo; Gao et al., 2016), or any combination thereof. In some embodiments, the nuclease may be a catalytically dead endonuclease, such as a catalytically dead CRISPR associated protein 9 (dCas9), dCpf1, dCasX, dCasY, or any combination thereof. Other nucleases not explicitly mentioned here may nevertheless be encompassed in the present description. In some embodiments, the nuclease may be fused to a nuclear localization signal (e.g., Cas9-NLS; Cpf1-NLS; ZFN-NLS; TALEN-NLS). In some embodiments, the nuclease may be complexed with a nucleic acid (e.g., one or more guide RNAs, a crRNA, a tracrRNAs, or both a crRNA and a tracrRNA). In some embodiments, the nuclease may possess DNA or RNA-binding activity, but may lack the ability to cleave DNA.

In some embodiments, the shuttle agents of the present description may be used for intracellular delivery (e.g., nuclear delivery) of one or more CRISPR endonucleases, for example one or more of the CRISPR endonucleases described below.

Type I and its subtypes A, B, C, D, E, F and I, including their respective Cas1, Cas2, Cas3, Cas4, Cas6, Cas7 and Cas8 proteins, and the signature homologs and subunits of these Cas proteins including Cse1, Cse2, Cas7, Cas5, and Cas6e subunits in *E. coli* (type I-E) and Csy1, Csy2, Csy3, and Cas6f in *Pseudomonas aeruginosa* (type I-F) (Wiedenheft et al., 2011; Makarova et al, 2011). Type II and its subtypes A, B, C, including their respective Cas1, Cas2 and Cas9 proteins, and the signature homologs and subunits of these Cas proteins including Csn complexes (Makarova et al, 2011). Type III and its subtypes A, B and MTH326-like module, including their respective Cas1, Cas2, Cas6 and Cas10 proteins, and the signature homologs and subunits of these Cas proteins including Csm and CMR complexes (Makarova et al, 2011). Type IV represents the Csf3 family of Cas proteins. Members of this family show up near CRISPR repeats in *Acidithiobacillus ferrooxidans* ATCC 23270, *Azoarcus* sp. (strain EbN1), and *Rhodoferax ferrireducens* (strain DSM 15236/ATCC BAA-621/T118). In the latter two species, the CRISPR/Cas locus is found on a plasmid. Type V and it subtypes have only recently been discovered and include Cpf1, C2c1, and C2c3. Type VI includes the enzyme C2c2, which reported shares little homology to known sequences.

In some embodiments, the shuttle agents of the present description may be used in conjunction with one or more of the nucleases, endonucleases, RNA-guided endonuclease, CRISPR endonuclease described above, for a variety of applications, such as those described herein. CRISPR systems interact with their respective nucleic acids, such as DNA binding, RNA binding, helicase, and nuclease motifs (Makarova et al, 2011; Barrangou & Marraffini, 2014). CRISPR systems may be used for different genome editing applications including:

a Cas-mediated genome editing method conducting to non-homologous end-joining (NHEJ) and/or Homologous-directed recombination (HDR) (Cong et al, 2013);

a catalytically dead Cas (dCas) that can repress and/or activate transcription initiation when bound to promoter sequences, to one or several gRNA(s) and to a RNA polymerase with or without a complex formation with others protein partners (Bikard et al, 2013);

a catalytically dead Cas (dCas) that can also be fused to different functional proteins domains as a method to bring enzymatic activities at specific sites of the genome including transcription repression, transcription activation, chromatin remodeling, fluorescent reporter, histone modification, recombinase system acetylation, methylation, ubiquitylation, phosphorylation, sumoylation, ribosylation and citrullination (Gilbert et al, 2013).

The person of ordinary skill in the art will understand that the present shuttle agents, although exemplified with Cas9 and Cpf1 in the present examples, may be used with other nucleases as described herein. Thus, nucleases such as Cpf1, Cas9, and variants of such nucleases or others, are encompassed by the present description. It should be understood that, in one aspect, the present description may broadly cover any cargo having nuclease activity, such an RNA-guided endonuclease, or variants thereof (e.g., those that can bind to DNA or RNA, but have lost their nuclease activity; or those that have been fused to a transcription factor).

In some embodiments, the polypeptide cargo may be a cytokine such as a chemokine, an interferon, an interleukin, a lymphokine, or a tumour necrosis factor. In some embodiments, the polypeptide cargo may be a hormone or growth factor. In some embodiments, the cargo may be an antibody (e.g., a labelled antibody, a therapeutic antibody, an anti-apoptotic antibody, an antibody that recognizes an intracellular antigen). In some embodiments, the cargo can be a detectable label (fluorescent polypeptide or reporter enzyme) that is intended for intracellular delivery, for example, for research and/or diagnostic purposes.

In some embodiments, the cargo may be a globular protein or a fibrous protein. In some embodiments, the cargo may have a molecule weight of any one of about 5, 10, 15, 20, 25, 30, 35, 40, 45, to 50 to about 150, 200, 250, 300, 350, 400, 450, 500 kDa or more. In some embodiments, the cargo may have a molecule weight of between about 20 to 200 kDa.

In some embodiments, the polypeptide cargo may be a peptide cargo, such as peptide that recognizes an intracellular molecule.

In some embodiments, the polypeptide cargo may be an enzyme and/or an enzyme inhibitor.

In some embodiments, peptide shuttle agents of the present description may be useful for delivering a polypeptide cargo from an extracellular space to the cytosol and/or nucleus of different types of target eukaryotic cells, wherein the synthetic peptide shuttle agent is used at a concentration sufficient to increase the transduction efficiency of said polypeptide cargo, as compared to in the absence of said synthetic peptide shuttle agent. The target eukaryotic cells may be an animal cell, a mammalian cell, or a human cell. In some embodiments, the target eukaryotic cells may be a stem cell (e.g., embryonic stem cells, pluripotent stem cells, induced pluripotent stem cells, neural stem cells, mesenchymal stem cells, hematopoietic stem cells, peripheral blood stem cells), a primary cell (e.g., myoblast, fibroblast), or an immune cell (e.g., NK cell, T cell, dendritic cell, antigen presenting cell). It will be understood that cells that are often resistant or not amenable to protein transduction may be interesting candidates for the synthetic peptides or polypeptide-based shuttle agents of the present description.

Non-Toxic, Metabolizable Shuttle Agents

In some embodiments, the shuttle agents of the present description may be non-toxic to the intended target eukaryotic cells at concentrations up to 50 µM, 45 µM, 40 µM, 35 µM, 30 µM, 25 µM, 20 µM, 15 µM, 10 µM, 9 µM, 8 µM, 7 µM, 6 µM, 5 µM, 4 µM, 3 µM, 2 µM, 1 µM, 0.5 µMm 0.1 µM, or 0.05 µM. Cellular toxicity of shuttle agents of the present description may be measured using any suitable method. Furthermore, transduction protocols may be adapted (e.g., concentrations of shuttle and/or cargo used, shuttle/cargo exposure times, exposure in the presence or absence of serum), to reduce or minimize toxicity of the shuttle agents, and/or to improve/maximize transfection efficiency.

In some embodiments, shuttle agents of the present description may be readily metabolizable by intended target eukaryotic cells. For example, the shuttle agents may consist entirely or essentially of peptides or polypeptides, for which the target eukaryotic cells possess the cellular machinery to metabolize/degrade. Indeed, the intracellular half-life of the synthetic peptides and polypeptide-based shuttle agents of the present description is expected to be much lower than the half-life of foreign organic compounds such as fluorophores. However, fluorophores can be toxic and must be investigated before they can be safely used clinically (Alford et al., 2009). In some embodiments, shuttle agents of the present description may be suitable for clinical use. In some embodiments, the shuttle agents of the present description may avoid the use of domains or compounds for which toxicity is uncertain or has not been ruled out.

Cocktails

In some embodiments, the present description relates to a composition comprising a cocktail of at least 2, at least 3, at least 4, or at least 5 different types of the synthetic peptides or polypeptide-based shuttle agents as defined herein. In some embodiments, combining different types of synthetic peptides or peptide shuttle agents (e.g., different shuttle agents comprising different types of domains) may provide increased versatility for delivering different polypeptide cargos intracellularly. Furthermore, without being bound by theory, combining lower concentrations of different types of shuttle agents may help reduce cellular toxicity associated with using a single type of shuttle agent (e.g., at higher concentrations).

Methods, Kits, Uses and Cells

In some embodiments, the present description relates to methods for delivering a polypeptide cargo from an extracellular space to the cytosol and/or nucleus of a target eukaryotic cell. The methods comprise contacting the target eukaryotic cell with the polypeptide cargo in the presence of a shuttle agent at a concentration sufficient to increase the transduction efficiency of said polypeptide cargo, as compared to in the absence of said shuttle agent. In some embodiments, contacting the target eukaryotic cell with the polypeptide cargo in the presence of the shuttle agent results in an increase in the transduction efficiency of said polypeptide cargo by at least 10-fold, 20-fold, 30-fold, 40-fold, 50-fold, or 100-fold, as compared to in the absence of said shuttle agent.

In some embodiments, the present description relates to a method for increasing the transduction efficiency of a polypeptide cargo to the cytosol of a target eukaryotic cell. As used herein, the expression "increasing transduction efficiency" refers to the ability of a shuttle agent of the present description to improve the percentage or proportion of a population of target cells into which a cargo of interest (e.g., a polypeptide cargo) is delivered intracellularly across the plasma membrane. Immunofluorescence microscopy, flow cytometry, and other suitable methods may be used to assess cargo transduction efficiency. In some embodiments, a shuttle agent of the present description may enable a transduction efficiency of at least 25%, 30%, 35%, 40%, 45%, 50%, 55%, 60%, 65%, 70%, 75%, 80%, or 85%, for example as measure by immunofluorescence microscopy, flow cytometry, FACS, and other suitable methods. In some embodiments, a shuttle agent of the present description may enable one of the aforementioned transduction efficiencies together wish a cell viability of at least 25%, 30%, 35%, 40%, 45%, 50%, 55%, 60%, 65%, 70%, 75%, 80%, 85%, 90%, or 95%, for example as measure by the assay described in Example 3.3a, or by another suitable assay known in the art.

In addition to increasing target cell transduction efficiency, shuttle agents of the present description may facilitate the delivery of a cargo of interest (e.g., a polypeptide cargo) to the cytosol of target cells. In this regard, efficiently delivering an extracellular cargo to the cytosol of a target cell using peptides can be challenging, as the cargo often becomes trapped in intracellular endosomes after crossing the plasma membrane, which may limit its intracellular availability and may result in its eventual metabolic degradation. For example, use of the protein transduction domain from the HIV-1 Tat protein has been reported to result in massive sequestration of the cargo into intracellular vesicles. In some aspects, shuttle agents of the present description may facilitate the ability of endosomally-trapped cargo to escape from the endosome and gain access to the cytoplasmic compartment. In this regard, the expression "to the cytosol" in the phrase "increasing the transduction efficiency of an independent polypeptide cargo to the cytosol," is intended to refer to the ability of shuttle agents of the present description to allow an intracellularly delivered cargo of interest to escape endosomal entrapment and gain access to the cytoplasmic compartment. After a cargo of interest has gained access to the cytosol, it may be subsequently targeted to various subcellular compartments (e.g., nucleus, nucleolus, mitochondria, peroxisome). In some embodiments, the expression "to the cytosol" is thus intended to encompass not only cytosolic delivery, but also delivery to other subcellular compartments that first require the cargo to gain access to the cytoplasmic compartment.

In some embodiments, the methods of the present description are in vitro methods. In other embodiments, the methods of the present description are in vivo methods.

In some embodiments, the methods of the present description may comprise contacting the target eukaryotic cell with the shuttle agent, or composition as defined herein, and the polypeptide cargo. In some embodiments, the shuttle agent, or composition may be pre-incubated with the polypeptide cargo to form a mixture, prior to exposing the target eukaryotic cell to that mixture. In some embodiments, the type of shuttle agent may be selected based on the amino acid sequence of the polypeptide cargo to be delivered intracellularly. In other embodiments, the type of shuttle agent may be selected to take into account the amino acid sequence of the polypeptide cargo to be delivered intracellularly, the type of cell, the type of tissue, etc.

In some embodiments, the method may comprise multiple treatments of the target cells with the shuttle agent, or composition (e.g., 1, 2, 3, 4 or more times per day, and/or on a pre-determined schedule). In such cases, lower concentrations of the shuttle agent, or composition may be advisable (e.g., for reduced toxicity). In some embodiments, the cells may be suspension cells or adherent cells. In some embodiments, the person of skill in the art will be able to adapt the teachings of the present description using different combinations of shuttles, domains, uses and methods to suit particular needs of delivering a polypeptide cargo to particular cells with a desired viability.

In some embodiments, the methods of the present description may apply to methods of delivering a polypeptide cargo intracellularly to a cell in vivo. Such methods may be accomplished by parenteral administration or direct injection into a tissue, organ, or system.

In some embodiments, the shuttle agent, or composition, and the polypeptide cargo may be exposed to the target cell in the presence or absence of serum. In some embodiments, the method may be suitable for clinical or therapeutic use.

In some embodiments, the present description relates to a kit for delivering a polypeptide cargo from an extracellular space to the cytosol and/or nucleus of a target eukaryotic cell. In some embodiments, the present description relates to a kit for increasing the transduction efficiency of a polypeptide cargo to the cytosol of a target eukaryotic cell. The kit may comprise the shuttle agent, or composition as defined herein, and a suitable container.

In some embodiments, the target eukaryotic cells may be an animal cell, a mammalian cell, or a human cell. In some embodiments, the target eukaryotic cells may be a stem cell (e.g., embryonic stem cells, pluripotent stem cells, induced pluripotent stem cells, neural stem cells, mesenchymal stem cells, hematopoietic stem cells, peripheral blood stem cells), a primary cell (e.g., myoblast, fibroblast), or an immune cell (e.g., NK cell, T cell, dendritic cell, antigen presenting cell). In some embodiments, the present description relates to an isolated cell comprising a synthetic peptide or polypeptide-based shuttle agent as defined herein. In some embodiments, the cell may be a protein-induced pluripotent stem cell. It will be understood that cells that are often resistant or not amenable to protein transduction may be interesting candidates for the synthetic peptides or polypeptide-based shuttle agents of the present description.

In some embodiments, the present description relates to a method for producing a synthetic peptide shuttle agent that delivers a polypeptide cargo from an extracellular space to the cytosol and/or nucleus of a target eukaryotic cell, the method comprising synthesizing a peptide which is:
  (1) a peptide at least 20 amino acids in length comprising
  (2) an amphipathic alpha-helical motif having
  (3) a positively-charged hydrophilic outer face, and a hydrophobic outer face,
wherein at least five of the following parameters (4) to (15) are respected:
  (4) the hydrophobic outer face comprises a highly hydrophobic core consisting of spatially adjacent L, I, F, V, W, and/or M amino acids representing 12 to 50% of the amino acids of the peptide, based on an open cylindrical representation of the alpha-helix having 3.6 residues per turn;
  (5) the peptide has a hydrophobic moment ($\mu$) of 3.5 to 11;
  (6) the peptide has a predicted net charge of at least +4 at physiological pH;
  (7) the peptide has an isoelectric point (pI) of 8 to 13;
  (8) the peptide is composed of 35% to 65% of any combination of the amino acids: A, C, G, I, L, M, F, P, W, Y, and V;
  (9) the peptide is composed of 0% to 30% of any combination of the amino acids: N, Q, S, and T;
  (10) the peptide is composed of 35% to 85% of any combination of the amino acids: A, L, K, or R;
  (11) the peptide is composed of 15% to 45% of any combination of the amino acids: A and L, provided there being at least 5% of L in the peptide;
  (12) the peptide is composed of 20% to 45% of any combination of the amino acids: K and R;
  (13) the peptide is composed of 0% to 10% of any combination of the amino acids: D and E;
  (14) the difference between the percentage of A and L residues in the peptide (% A+L), and the percentage of K and R residues in the peptide (% K+R), is less than or equal to 10%; and
  (15) the peptide is composed of 10% to 45% of any combination of the amino acids: Q, Y, W, P, I, S, G, V, F, E, D, C, M, N, T, and H.

In some embodiments, the present description relates to a method for identifying a shuttle agent that delivers a polypeptide cargo from an extracellular space to the cytosol and/or nucleus of a target eukaryotic cell, the method comprising: (a) synthesizing a peptide which is the peptide as defined herein; (b) contacting the target eukaryotic cell with the polypeptide cargo in the presence of said peptide; (c) measuring the transduction efficiency of the polypeptide cargo in the target eukaryotic cell; and (d) identifying the peptide as being a shuttle agent that transduces the polypeptide cargo, when an increase in the transduction efficiency of said polypeptide cargo in the target eukaryotic cell is observed.

In some embodiments, the present description relates to a genome editing system comprising: (a) the shuttle agent as defined herein; (b) a CRISPR-associated endonuclease; and (c) one or more guide RNAs. In some embodiments, the genome editing system may further comprise a linear DNA template for controlling the genome editing.

Genome Editing for Improved Cell Therapy

In some embodiments, the shuttle agents, synthetic peptides, compositions, and methods described herein may be used for transducing genome-editing complexes (e.g., the CRISPR-based genome editing complexes) to genetically engineer cells for improved cell therapy, as compared to native cells or unengineered cells. Such improvements may include, for example, reducing the immunogenicity of the engineered cells and/or improving the activity/efficacy of the engineered cells.

Particularly attractive immune cells for genome engineering may be natural killer (NK) cells, given their natural ability to recognize and kill tumor cells. Accordingly, in some embodiments, the present description relates to the use of the shuttle agents, synthetic peptides, compositions, and methods described herein for transducing genome-editing complexes (e.g., the CRISPR-based genome editing complexes) to genetically engineer NK (or other immune cells that would benefit from the same modifications) for improved cell-based immunotherapy. For example, the present description may relate to the intracellular delivery of one or more CRISPR-based genome editing complexes that comprise a guide RNA and/or linear DNA template targeting the CBLB gene, c-CBL gene, GSK3 gene, ILT2 gene, CISH gene, NKG2a gene, B2M gene, or any combination thereof. Such gene targets may potentiate NK-mediated cellular cytotoxicity following knockout, as discussed below.

1. NKG2A (KLRC1, CD159A, Killer Cell Lectin-Like Receptor C1)

CD94/NKG2A acts as an MHC class-I specific NK inhibitory receptor (Braud et al., 1998; Lee et al., 1998). It is expressed by a subset of NK cells known as CD56$^{bright}$ CD16$^{dim}$ (~10% of peripheral NK), which are typically less cytotoxic (Cooper et al., 2001; Poli et al., 2009). NKG2A ligands are the non-classical MHC class-I HLA-E molecules that are expressed in every human cell. The recognition of HLA-E by the NKG2A receptor is part of the "self-tolerance" mechanism (also including KIR receptors), resulting in negative modulation of NK cell cytotoxicity (Lee et al., 1998).

There exists clinical evidence demonstrating the role of non-classical HLA class I, mainly HLA-E and HLA-G (see ILT-2 target), in evading immune surveillance resulting in higher cancer relapses and decrease overall survival following surgery (de Kruijf et al., 2010; Levy et al., 2008; Ye et al., 2007a; Yie et al., 2007b; Yie et al., 2007c; Yie et al., 2007d; Guo et al., 2015; Ishigami et al., 2015; Zhen et al., 2013). The use of NKG2A-KO NK cells during adoptive cell therapy may counteract the presence of HLA-E molecules (membrane-bound or solubles) in tumor microenvironment. In addition, NK cells expanded from IL15 or IL21-expressing K562 feeder cells lead to a high percentage of NKG2A$^{pos}$ cells (Denman et al., 2012), and it may be desirable to knockout this inhibitory receptor during the expansion process. Furthermore, the results in Example G.9 demonstrate that NKG2A-KO NK92 cells are significantly more cytotoxic against IFN-gamma-treated HeLa cells.

2. ILT2 (Ig-Like Transcript 2 Gene)

ILT2 is an inhibitory receptor expressed on several immune cells, including NK cells (Kirwan et al., 2005). The ligands for this receptor are HLA-G molecules, which are naturally expressed only in thymus and trophoblasts. However, many tumors gain the capacity to express HLA-G to escape immune cell attack by inhibition through ILT2 receptor activation. In fact, NKL$^{ILT2}$-cells are more potent than parental NKL against HLA-G-overexpressing K562 cells (Wu et al., 2015). Moreover, overexpression of HLA-G in OVCAR-3 cancer cells impaired NK cell-mediated cytotoxicity (Lin et al., 2007). As for HLA-E, expression of HLA-G on cancer cells is generally associated with poor prognosis.

3. c-Cbl and Cbl-b (Casitas B-Lineage Lymphoma Proto-Oncogene Family).

These genes (from the Casitas B-lineage lymphoma proto-oncogene, Cbl family) encode for E3 ligases, which are function in the protein ubiquitylation pathway (regulation of cellular protein content). E3 ligases catalyze the formation of a covalent bond between Ub (ubiquitin) and specific lysine residues on targeted proteins (more than thousand E3 ligases in mammalians). Cbl family members are involved in negative regulation of signaling by receptor tyrosine kinases on immune cells by binding and ubiquitylating phosphorylated receptor and adaptors (Liu et al., 2014; utz-Nicoladoni, 2015). One demonstrated that both c-cbl and Cbl-b ubiquitylate phosphorylated LAT adaptor. Phosphorylation of LAT following NK cell activation is required to recruit other mediators, especially PLC-$\gamma$ and siRNA-mediated c-cbl and Cbl-b knockdown increased NK cell activity against B cell lymphoma 721.221-Cw4 (Matalon et al., 2016).

Others identified TAM (Tyro3, Axl, Mer) receptors as targets for Cbl-b ubiquitylation (Paolino et al., 2014). However, assuming that TAM receptors are proposed to negatively regulate NK cells, Cbl-b knockout should rather be associated to a decrease in NK cell activity. Therefore, TAM receptors may be considered as a good target to enhance NK cells but unlikely via Cbl-b knockout.

In vivo studies demonstrated that Cbl-b$^{-/-}$ mice prevent primary tumor growth (Loeser et al., 2007). In addition, NK cells isolated from these mice have increased proliferation and IFN-$\gamma$ production when activated (Paolino et al., 2014).

4. GSK3B (Glycogen Synthase Kinase Beta)

GSK3b is a Ser/Thr kinase involved in several cellular functions, such as proliferation, apoptosis, inflammatory response, stress, and others (Patel et al., 2017). Inhibition of GSK3b (using small inhibitors) in NK cells leads to increase cytotoxicity (likely through IFN-g, TNF-$\alpha$ production, 2B4 stimulation and up-regulation of LFA-1) against AML (OCI-AML3) (Parameswaran et al., 2016; Aoukaty et al., 2005). We have recently demonstrated that the GSK3$\beta$ inhibitor, SB216763, enhances the cytotoxic activity of NK92 against HeLa cells (data not shown). This effect is increased by co-incubation with IL-15.

5. CISH (Cytokine-Inducible SH2-Containing Protein)

CIS protein is a member of the suppressor of cytokine signaling (SOCS) proteins, which bind to phosphorylated JAKs and inhibit JAK-STAT signaling pathways. Recently, Cish-/- mice demonstrated that CIS is a key suppressor of IL15 signaling in NK cells (Delconte et al., 2016). Following IL15 exposure, these cells have prolonged IL15 responses, an elevated IFN-g production, and an increased cytotoxic potential. Moreover, there is a clear relationship between IL15 responsiveness and NKG2D-dependent cytotoxicity (Horng et al., 2007).

In clinical trials, co-injection of cytokines, such as IL2 and IL15, during adoptive NK-cell therapy is strongly recommended to sustain NK cell activity. However, such a co-injection induces serious side effects to patients. The use of IL15-hypersensitive NK cells (CISH knockout) would benefit the treatment.

In some embodiments, disrupting the B2M gene encoding β2 microglobulin (B2M), a component of MHC class I molecules, may substantially reduce the immunogenicity of every cell expressing MHC class I. In other aspects, the genome of NK cells can be modified after the delivery of a genome editing system as described herein. More specifically, the cytotoxicity of NK cells can be improved after the delivery of a genome editing system targeting specific putative targets that may potentiate NK-mediated cellular cytotoxicity such as the NKG2A, ILT2, c-Cbl, Cbl-b, GSK3B and CISH genes.

Co-Transduction with a Polypeptide Cargo of Interest and a Marker Protein

The ability of domain-based and rationally-designed peptide shuttle agents to co-transduce two different polypeptide cargos into a population of target eukaryotic cells has been demonstrated herein and in PCT patent application publication No. WO/2016/161516. Example I of the present description shows that co-transducing a polypeptide cargo of interest (e.g., a CRISPR-endonuclease) and an independent marker protein (e.g., GFP) in a population of target eukaryotic cells may not necessarily increase the overall transduction efficiency of the polypeptide cargo of interest. However, it was surprisingly discovered that a strikingly high proportion of target eukaryotic cells that were successfully transduced with the polypeptide cargo of interest, were also successfully transduced with the marker protein. Conversely, a strikingly high proportion of cells that were not transduced with the polypeptide cargo of interest, were also not transduced with the marker protein. Isolating cells positive for the marker protein (e.g., via FACS) resulted in a significant increase in the proportion of cells that were successfully transduced with the polypeptide cargo of interest, and the correlation was found to be concentration dependent in that cell populations exhibiting the highest fluorescence of the marker protein also exhibited the highest proportion of transduction with the polypeptide cargo of interest.

In some aspects, the present description relates to a method for enriching eukaryotic cells transduced with a polypeptide cargo of interest. The method may comprise (a) co-transducing a target eukaryotic cell population with a polypeptide cargo of interest and a marker protein; and (b) isolating or concentrating eukaryotic cells transduced with the marker protein, thereby enriching eukaryotic cells transduced with the polypeptide cargo of interest.

In some embodiments, the marker protein may not be covalently bound to the polypeptide cargo of interest (e.g., the marker protein is independent from the polypeptide cargo of interest), the marker protein may be covalently bound to the polypeptide cargo of interest, the marker protein may be non-covalently bound to the polypeptide cargo of interest (e.g., electrostatically and/or conformationally bound via a protein domain-protein domain interaction), or the marker protein is covalently bound to the polypeptide cargo of interest via a cleavable linker (e.g., a linker peptide comprising an enzyme cleavage site, such as an enzyme expressed in endosomes, lysosomes, or in the cytosol). In some embodiments, the intracellular concentration of the transduced marker protein may be positively correlated with the intracellular concentration of the transduced polypeptide cargo of interest.

In some embodiments, the marker protein may comprise a detectable label. As used herein, "detectable label" refers to a molecule or particle that enables a person of skill in the art to identify and separate cells comprising the label from cells lacking the label. In some embodiments, the marker protein may be a fluorescent protein, a fluorescently-labeled protein, a bioluminescent protein, an isotopically-labelled protein, a magnetically-labeled protein, or another detectable label that enables separation of cells containing the marker protein from cells lacking the marker protein, or enables separation of cells based on the level of intracellular marker protein.

In some embodiments, eukaryotic cells transduced with the marker protein may be isolated or concentrated using flow cytometry, fluorescence-activated cell sorting (FACS), magnetic-activated cell sorting (MACS), or other known cell separation/sorting technologies. Isolating or enriching successfully transduced cells may be particularly advantageous, for example, for polypeptide cargoes such as functional CRISPR-based genome-editing complexes, which may be associated with relatively lower transduction efficiencies.

It was also surprisingly disclosed herein in Example I that cells that were unsuccessfully transduced following a first round of transduction with a polypeptide cargo of interest, may be isolated and re-transduced with the polypeptide cargo of interest in subsequent rounds of transduction. These results suggest that, although the cells unsuccessfully transduced following a first round of transduction with a polypeptide cargo of interest are not necessarily refractory to subsequent transductions.

In some embodiments, the present description relates to a method for enriching eukaryotic cells transduced with a polypeptide cargo of interest, the method comprising: (a) co-transducing a target eukaryotic cell population with a polypeptide cargo of interest and a marker protein; (b) isolating eukaryotic cells transduced with the marker protein from cells lacking the marker protein, thereby producing a marker protein-positive cell population and a marker protein-negative cell population. In some embodiments, steps (a) and (b) may be repeated, one or more times, on the marker protein-negative cell population, on the marker protein-positive cell population, or on both the marker protein-negative and the marker protein-positive cell populations. In some embodiments, the method for enriching eukaryotic cells transduced with a polypeptide cargo of interest may be automated, for example, by isolating cells negative for transduction with the marker protein and re-transducing the marker protein-negative cell population.

In some embodiments, the present description relates to a method for enriching eukaryotic cells transduced with a polypeptide cargo of interest, the method comprising: (a) co-transducing a target eukaryotic cell population with a polypeptide cargo of interest and a marker protein; and (b) isolating eukaryotic cells transduced with the marker protein based on their intracellular concentration of the marker protein.

In some embodiments, the marker protein described herein may be a protein that stimulates cell proliferation (e.g., a growth factor or a transcription factor), a protein that stimulates cell differentiation, a protein that promotes cell survival, an anti-apoptotic protein, or a protein having another biological activity.

In some embodiments, the polypeptide cargo of interest and the marker protein may be co-transduced by contacting the target eukaryotic cell with the polypeptide cargo and the marker protein in the presence of a peptide transduction agent, wherein the peptide transduction agent is present at a concentration sufficient to increase the transduction efficiency of the polypeptide cargo and the marker protein, as compared to in the absence of said peptide transduction agent. In some embodiments, the peptide transduction agent may be an endosomolytic peptide. In some embodiments, the peptide transduction agent is or comprises a domain-based peptide shuttle agent, or a rationally designed peptide shuttle agent as defined herein, in PCT patent application publication No. WO/2016/161516, and/or U.S. Pat. No. 9,738,687. In some embodiments, the aforementioned domain-based peptide shuttle agent may be a synthetic peptide comprising an endosome leakage domain (ELD) operably linked to a cell penetrating domain (CPD), or an ELD operably linked to a histidine-rich domain and a CPD. In some embodiment, the aforementioned domain-based peptide shuttle agent: (a) comprises a minimum length of 20, 21, 22, 23, 24, 25, 26, 27, 28, 29, or 30 amino acid residues and a maximum length of 35, 40, 45, 50, 55, 65, 70, 75, 80, 85, 90, 95, 100, 105, 110, 115, 120, 125, 130, 135, 140, 145, or 150 amino acid residues; (b) has a predicted net charge of at least +4, +5, +6, +7, +8, +9, +10, +11, +12, +13, +14, or +15 at physiological pH; (c) is soluble in aqueous solution; or (d) any combination of (a) to (c). In some embodiments, the ELD, CPD, histidine-rich domain, linker domain, are as defined herein. In some embodiments, the target eukaryotic cells comprise or consist of animal cells, mammalian cells, human cells, stem cells, primary cells, immune cells, T cells, NK cells, dendritic cells, or other types or sub-types of cells.

In some embodiments, the polypeptide cargo of interest may be: (i) the polypeptide cargo as defined herein; and/or (ii) one or more CRISPR-associated endonucleases alone or with one or more corresponding guide RNA and/or linear DNA templates as defined herein.

Items

In some embodiments, the present description may relate to the following items:
1. A method for delivering a polypeptide cargo from an extracellular space to the cytosol and/or nucleus of a target eukaryotic cell, said method comprising contacting the target eukaryotic cell with the polypeptide cargo in the presence of a shuttle agent at a concentration sufficient to increase the transduction efficiency of said polypeptide cargo, as compared to in the absence of said shuttle agent, wherein said shuttle agent is
- (1) a peptide at least 20 amino acids in length comprising
- (2) an amphipathic alpha-helical motif having
- (3) a positively-charged hydrophilic outer face, and a hydrophobic outer face, wherein at least five of the following parameters (4) to (15) are respected:
- (4) the hydrophobic outer face comprises a highly hydrophobic core consisting of spatially adjacent L, I, F, V, W, and/or M amino acids representing 12 to 50% of the amino acids of the peptide, based on an open cylindrical representation of the alpha-helix having 3.6 residues per turn;
- (5) the peptide has a hydrophobic moment (µ) of 3.5 to 11;
- (6) the peptide has a predicted net charge of at least +4 at physiological pH;
- (7) the peptide has an isoelectric point (pI) of 8 to 13;
- (8) the peptide is composed of 35% to 65% of any combination of the amino acids: A, C, G, I, L, M, F, P, W, Y, and V;
- (9) the peptide is composed of 0% to 30% of any combination of the amino acids: N, Q, S, and T;
- (10) the peptide is composed of 35% to 85% of any combination of the amino acids: A, L, K, or R;
- (11) the peptide is composed of 15% to 45% of any combination of the amino acids: A and L, provided there being at least 5% of L in the peptide;
- (12) the peptide is composed of 20% to 45% of any combination of the amino acids: K and R;
- (13) the peptide is composed of 0% to 10% of any combination of the amino acids: D and E;
- (14) the difference between the percentage of A and L residues in the peptide (% A+L), and the percentage of K and R residues in the peptide (K+R), is less than or equal to 10%; and
- (15) the peptide is composed of 10% to 45% of any combination of the amino acids: Q, Y, W, P, I, S, G, V, F, E, D, C, M, N, T and H.

2. The method of item 1, wherein the shuttle agent respects at least six, at least seven, at least eight, at least nine, at least ten, at least eleven, or respects all of parameters (4) to (15).

3. The method of item 1 or 2, wherein:
- (i) said shuttle agent is a peptide having a minimum length of 20, 21, 22, 23, 24, 25, 26, 27, 28, 29, or 30 amino acids, and a maximum length of 40, 41, 42, 43, 44, 45, 46, 47, 48, 49, 50, 51, 52, 53, 54, 55, 60, 65, 70, 80, 90, 100, 110, 120, 130, 140, or 150 amino acids;
- (ii) said amphipathic alpha-helical motif has a hydrophobic moment (p) between a lower limit of 3.5, 3.6, 3.7, 3.8, 3.9, 4.0, 4.1, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, 6.5, 6.6, 6.7, 6.8, 6.9, 7.0, and an upper limit of 9.5, 9.6, 9.7, 9.8, 9.9, 10.0, 10.1, 10.2, 10.3, 10.4, 10.5, 10.6, 10.7, 10.8, 10.9, or 11.0;
- (iii) said amphipathic alpha-helical motif comprises a positively-charged hydrophilic outer face comprising: (a) at least two, three, or four adjacent positively-charged K and/or R residues upon helical wheel projection; and/or (b) a segment of six adjacent residues comprising three to five K and/or R residues upon helical wheel projection, based on an alpha helix having angle of rotation between consecutive amino acids of 100 degrees and/or an alpha-helix having 3.6 residues per turn;
- (iv) said amphipathic alpha-helical motif comprises a hydrophobic outer face comprising: (a) at least two adjacent L residues upon helical wheel projection; and/or (b) a segment of ten adjacent residues comprising at least five hydrophobic residues selected from: L, I, F, V, W, and M, upon helical wheel projection, based on an alpha helix having angle of rotation between consecutive amino acids of 100 degrees and/or an alpha-helix having 3.6 residues per turn;
- (v) said hydrophobic outer face comprises a highly hydrophobic core consisting of spatially adjacent L, I, F, V, W, and/or M amino acids representing from 12.5%, 13%, 13.5%, 14%, 14.5%, 15%, 15.5%, 16%, 16.5%, 17%, 17.5%, 18%, 18.5%, 19%, 19.5%, or 20%, to 25%, 30%, 35%, 40%, or 45% of the amino acids of the peptide;
- (vi) said peptide has a hydrophobic moment (p) between a lower limit of 4.0, 4.1, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, 6.5, 6.6, 6.7, 6.8, 6.9, 7.0, and an upper limit of 9.5, 9.6, 9.7, 9.8, 9.9, 10.0, 10.1, 10.2, 10.3, 10.4, or 10.5;
- (vii) said peptide has a predicted net charge of between +4, +5, +6, +7, +8, +9, to +10, +11, +12, +13, +14, or +15;
- (viii) said peptide has a predicted pI of 10-13; or
- (ix) any combination of (i) to (viii).

4. The method of any one of items 1 to 3, wherein said shuttle agent respects at least one, at least two, at least three, at least four, at least five, at least six, or all of the following parameters:
- (8) the peptide is composed of 36% to 64%, 37% to 63%, 38% to 62%, 39% to 61%, or 40% to 60% of any combination of the amino acids: A, C, G, I, L, M, F, P, W, Y, and V;
- (9) the peptide is composed of 1% to 29%, 2% to 28%, 3% to 27%, 4% to 26%, 5% to 25%, 6% to 24%, 7% to 23%, 8% to 22%, 9% to 21%, or 10% to 20% of any combination of the amino acids: N, Q, S, and T;
- (10) the peptide is composed of 36% to 80%, 37% to 75%, 38% to 70%, 39% to 65%, or 40% to 60% of any combination of the amino acids: A, L, K, or R;
- (11) the peptide is composed of 15% to 40%, 20% to 40%, 20 to 35%, or 20 to 30% of any combination of the amino acids: A and L;
- (12) the peptide is composed of 20% to 40%, 20 to 35%, or 20 to 30% of any combination of the amino acids: K and R;
- (13) the peptide is composed of 5 to 10% of any combination of the amino acids: D and E;
- (14) the difference between the percentage of A and L residues in the peptide (% A+L), and the percentage of K and R residues in the peptide (K+R), is less than or equal to 9%, 8%, 7%, 6%, or 5%; and
- (15) the peptide is composed of 15 to 40%, 20% to 35%, or 20% to 30% of any combination of the amino acids: Q, Y, W, P, I, S, G, V, F, E, D, C, M, N, T, and H.

5. The method of any one of items 1 to 4, wherein said peptide comprises a histidine-rich domain.

6. The method of item 5, wherein said histidine-rich domain is:
- (i) positioned towards the N terminus and/or towards the C terminus of the peptide;

(ii) is a stretch of at least 3, at least 4, at least 5, or at least 6 amino acids comprising at least 50%, at least 55%, at least 60%, at least 65%, at least 70%, at least 75%, at least 80%, at least 85%, or at least 90% histidine residues; and/or comprises at least 2, at least 3, at least 4, at least 5, at least 6, at least 7, at least 8, or at least 9 consecutive histidine residues; or (iii) both (i) and (ii).

7. The method of any one of items 1 to 6, wherein said peptide comprises a flexible linker domain rich in serine and/or glycine residues.

8. The method of any one of items 1 to 7, wherein said peptide comprises or consists of the amino acid sequence of: (a) [X1]-[X2]-[linker]-[X3]-[X4] (Formula 1); (b) [X1]-[X2]-[linker]-[X4]-[X3] (Formula 2); (c) [X2]-[X1]-[linker]-[X3]-[X4] (Formula 3); (d) [X2]-[X1]-[linker]-[X4]-[X3] (Formula 4); (e) [X3]-[X4]-[linker]-[X1]-[X2] (Formula 5); (f) [X3]-[X4]-[linker]-[X2]-[X1](Formula 6); (g) [X4]-[X3]-[linker]-[X1]-[X2] (Formula 7); or (h) [X4]-[X3]-[linker]-[X2]-[X1] (Formula 8), wherein: [X1] is selected from: 2[φ]-1[+]-2[φ]-1[ζ]-1[+]-; 2[φ]-1[+]-2[φ]-2[+]-; 1[+]-1[φ]-1[+]-2[φ]-1[ζ]-1[+]-; and 1[+]-1[φ]-1[+]-2[φ]-2[+]-; [X2] is selected from: -2[φ]-1[+]-2[φ]-2[ζ]-; -2[φ]-1[+]-2[φ]-2[+]-; -2[φ]-1[+]-2[φ]-1[+]-1[ζ]-; -2[φ]-1[+]-2[φ]-1[+]-2[φ]-1[ζ]-1[+]-; -2[φ]-2[+]-1[φ]-2[+]-; -2[φ]-2[+]-1[φ]-2[ζ]-; -2[φ]-2[+]-1[φ]-1[+]-1[ζ]-; and -2[φ]-2[+]-1[φ]-1[ζ]-1[+]-; [X3] is selected from: -4[+]-A-; -3[+]-G-A-; -3[+]-A-A-; -2[+]-1[φ]-1[+]-A-; -2[+]-1[φ]-G-A-; -2[+]-1[φ]-A-A-; or -2[+]-A-1[+]-A; -2[+]-A-G-A; -2[+]-A-A-A-; -1[φ]-3[+]-A-; -1[φ]-2[+]-G-A-; -1[φ]-2[+]-A-A-; -1[φ]-1[+]-1[φ]-1[+]-A; -1[φ]-1[+]- 1[φ]-G-A; -1[φ]-1[+]-1[φ]-A-A; -1[φ]-1[+]-A-1[+]-A; -1[φ]-1[+]-A-G-A; -1[φ]-1[+]-A-A-A; -A-1[+]-A-1[+]-A; -A-1[+]-A-G-A; and -A-1[+]-A-A-A; [X4] is selected from: -1[ζ]-2A-1[+]-A; -1[ζ]-2A-2[+]; -1[+]-2A-1[+]-A; -1[ζ]-2A-1[+]-1[ζ]-A-1[+]; -1[ζ]-A-1[ζ]-A-1[+]; -2[+]-A-2[+]; -2[+]-A-1[+]-A; -2[+]-A-1[+]-1[ζ]-A-1[+]; -2[+]-1[ζ]-A-1[+]; -1[+]-1[ζ]-A-1[+]-A; -1[+]-1[ζ]-A-2[+]; -1[+]-1[ζ]-A-1[+]-1[ζ]-A-1[+]; -1[+]-2[ζ]-A-1[+]; -1[+]-2[ζ]-2[+]; -1[ζ]-2-1[+]-A; -1[+]-2[ζ]-1[+]-1[ζ]-A-1[+]; -1[+]-2[ζ]-1[ζ]-A-1[+]; -3[ζ]-2[+]; -3[ζ]-1[+]-A; -3[ζ]-1[+]-1[ζ]-A-1[+]; -1[ζ]-2A-1[+]-A; - 1[ζ]-2A-2[+]; -1[ζ]-2A-1[+]-1[ζ]-A-1[+]; -2[+]-A-1[+]-A; -2[+]-1[ζ]-1[+]-A; -1[+]-1[ζ]-A-1[+]-A; -1[+]-2A-1[+]-1[ζ]-A-1[+]; and -1[ζ]-A-1[ζ]-A-1[+]; and [linker] is selected from: -Gn-; -Sn-; -(GnSn)n-; -(GnSn)nGn-; -(GnSn)nSn-; -(GnSn)nGn(GnSn)n-; and -(GnSn)nSn(GnSn)n-; wherein: [φ] is an amino acid which is: Leu, Phe, Trp, Ile, Met, Tyr, or Val; [+] is an amino acid which is: Lys or Arg; [ζ] is an amino acid which is: Gln, Asn, Thr, or Ser; A is the amino acid Ala; G is the amino acid Gly; S is the amino acid Ser; and n is an integer from 1 to 20, 1 to 19, 1 to 18, 1 to 17, 1 to 16, 1 to 15, 1 to 14, 1 to 13, 1 to 12, 1 to 11, 1 to 10, 1 to 9, 1 to 8, 1 to 7, 1 to 6, 1 to 5, 1 to 1 4, or 1 to 3.

9. The method of any one of items 1 to 8, wherein:
(i) said peptide is at least 50%, 55%, 60%, 65%, 70%, 75%, 80%, 85%, 90%, or 95% identical to the amino acid sequence of any one of SEQ ID NOs: 104, 105, 107, 108, 110-131, 133-135, 138, 140, 142, 145, 148, 151, 152, 169-242, and 243-10 242; or said peptide comprises or consists of a functional variant of any one of SEQ ID NOs: 104, 105, 107, 108, 110-131, 133-135, 138, 140, 142, 145, 148, 151, 152, 169-242, and 243-10 242;
(ii) said peptide:
(a) comprises or consists of the amino acid sequence of any one of SEQ ID NOs: 104, 105, 107, 108, 110-131, 133-135, 138, 140, 142, 145, 148, 151, 152, 169-242, and 243-10 242;
(b) comprises the amino acid sequence motifs of SEQ ID NOs: 158 and/or 159; or
(c) comprises the amino acid sequence motif of SEQ ID NO: 158 operably linked to the amino acid sequence motif of SEQ ID NO: 159; or
(iii) both (i) and (ii).

10. The method of any one of items 1 to 9, wherein the peptide comprises an endosome leakage domain (ELD), and/or a cell penetrating domain (CPD).

11. The method of item 10, wherein:
(i) said ELD is or is from: an endosomolytic peptide; an antimicrobial peptide (AMP); a linear cationic alpha-helical antimicrobial peptide; a Cecropin-A/Melittin hybrid (CM series) peptide; pH-dependent membrane active peptide (PAMP); a peptide amphiphile; a peptide derived from the N terminus of the HA2 subunit of influenza hemagglutinin (HA); CM18; Diphtheria toxin T domain (DT); GALA; PEA; INF-7; LAH4; HGP; H5WYG; HA2; EB1; VSVG; *Pseudomonas* toxin; melittin; KALA; JST-1; C(LLKK)$_3$C; G(LLKK)$_3$G; or any combination thereof;
(ii) said CPD is or is from: a cell-penetrating peptide or the protein transduction domain from a cell-penetrating peptide; TAT; PTD4; Penetratin (Antennapedia); pVEC; M918; Pep-1; Pep-2; Xentry; arginine stretch; transportan; SynB1; SynB3; or any combination thereof; or
(iii) both (i) and (ii).

12. The method of item 10 or 11, wherein said peptide comprises:
(a) an ELD comprising the amino acid sequence of any one of SEQ ID NOs: 1-15, 63, or 64, or a variant or fragment thereof having endosomolytic activity;
(b) a CPD comprising the amino acid sequence of any one of SEQ ID NOs: 16-27 or 65, or a variant or fragment thereof having cell penetrating activity; or
(c) both (a) and (b).

13. The method of any one of items 10 to 12, wherein:
(i) said peptide comprises an ELD which is CM18, KALA, or C(LLKK)$_3$C having the amino acid sequence of SEQ ID NO: 1, 14, or 63, or a variant thereof having at least 50%, 55%, 60%, 65%, 70%, 75%, 80%, 85%, 90%, or 95% identity to SEQ ID NO: 1, 14, or 63, and having endosomolytic activity;
(ii) wherein said peptide comprises a CPD which is TAT or PTD4 having the amino acid sequence of SEQ ID NO: 17 or 65, or a variant thereof having at least 50%, 55%, 60%, 65%, 70%, 75%, 80%, 85%, 90%, or 95% identity to SEQ ID NO: 17 or 65 and having cell penetrating activity; or
(iii) both (i) and (ii).

14. The method of any one of items 1 to 9, wherein said peptide comprises the amino acid sequence of any one of SEQ ID NOs: 57-59, 66-72, or 82-102, or a functional variant thereof having at least 85%, 90%, or 95% identity to any one of SEQ ID NOs: 57-59, 66-72, or 82-102.

15. The method of any one of items 1 to 14, wherein:
(i) said shuttle agent is completely metabolizable by the target eukaryotic cell; and/or
(ii) contacting the target eukaryotic cell with the polypeptide cargo in the presence of the shuttle agent at said concentration results in an increase in the transduction efficiency of said polypeptide cargo by at least 10-fold, 20-fold, 30-fold, 40-fold, 50-fold, or 100-fold, as compared to in the absence of said shuttle agent.

16. The method of any one of items 1 to 15, which is an in vitro method.

17. A synthetic peptide shuttle agent which is the peptide as defined in any one of items 1 to 15.

18. The synthetic peptide of item 17, which is a peptide between 20 and 100 amino acids in length comprising the amino acid sequence of any one of SEQ ID NOs: 104, 105, 107, 108, 110, 111, 112, 113, 114, 115, 116, 117, 118, 119, 120, 121, 122, 123, 124, 125, 126, 127, 128, 129, 130, 131, 133, 134, 135, 138, 140, 142, 145, 148, 151, 152, 169-242, and 243-10 242; or comprises the amino acid sequence motifs of SEQ ID NOs: 158 and/or 159.

19. The synthetic peptide shuttle agent of item 17 or 18 for use in delivering a polypeptide cargo from an extracellular space to the cytosol and/or nucleus of a target eukaryotic cell in vitro, wherein the synthetic peptide shuttle agent is used at a concentration sufficient to increase the transduction efficiency of said polypeptide cargo, as compared to in the absence of said synthetic peptide shuttle agent.

20. The synthetic peptide shuttle agent of item 17 or 18 for use in delivering a polypeptide cargo from an extracellular space to the cytosol and/or nucleus of a target eukaryotic cell in vivo, wherein the synthetic peptide shuttle agent is used at a concentration sufficient to increase the transduction efficiency of said polypeptide cargo, as compared to in the absence of said synthetic peptide shuttle agent.

21. A composition comprising the shuttle agent as defined in any one of items 1 to 15, or a cocktail of at least 2, at least 3, at least 4, or at least 5 different types of the shuttle agents as defined in any one of items 1 to 15, and a polypeptide cargo to be delivered from an extracellular space to the cytosol and/or nucleus of a target eukaryotic cell.

22. Use of the shuttle agent as defined in any one of items 1 to 15, or the synthetic peptide as defined in item 18, for delivering a polypeptide cargo from an extracellular space to the cytosol and/or nucleus of a target eukaryotic cell, wherein the shuttle agent or synthetic peptide is used at a concentration sufficient to increase the transduction efficiency of said polypeptide cargo, as compared to in the absence of said shuttle agent or synthetic peptide.

23. A kit for delivering a polypeptide cargo from an extracellular space to the cytosol and/or nucleus of a target eukaryotic cell, said kit comprising the shuttle agent as defined in any one of items 1 to 15, or the synthetic peptide as defined in item 18, and a suitable container.

24. The method of any one of items 1 to 16, the synthetic peptide shuttle agent of any one of items 17 to 20, the composition of item 21, the use of item 22, or the kit of item 23, wherein said polypeptide cargo lacks a cell penetrating domain.

25. The method of any one of items 1 to 16, the synthetic peptide shuttle agent of any one of items 17 to 20, the composition of item 21, the use of item 22, or the kit of item 23, wherein said polypeptide cargo comprises a cell penetrating domain.

26. The method of any one of items 1 to 16, 24 or 25, the synthetic peptide shuttle agent of any one of items 17 to 20, 24 or 25, the composition of any one of items 21, 24 or 25, the use of any one of items 22 to 25, wherein said polypeptide cargo comprises a subcellular targeting domain.

27. The method, the synthetic peptide shuttle agent, composition, use, or kit of item 26, wherein said subcellular targeting domain is:
 (a) a nuclear localization signal (NLS);
 (b) a nucleolar signal sequence;
 (c) a mitochondrial signal sequence; or
 (d) a peroxisome signal sequence.

28. The method, the synthetic peptide shuttle agent, composition, use, or kit of item 27, wherein:
 (a) said NLS is from: E1a, T-Ag, c-myc, T-Ag, op-T-NLS, Vp3, nucleoplasmin, histone 2B, *Xenopus* N1, PARP, PDX-1, QKI-5, HCDA, H2B, v-Rel, Amida, RanBP3, Pho4p, LEF-1, TCF-1, BDV-P, TR2, SOX9, or Max;
 (b) said nucleolar signal sequence is from BIRC5 or RECQL4;
 (c) said mitochondrial signal sequence is from Tim9 or Yeast cytochrome c oxidase subunit IV; or
 (d) said peroxisome signal sequence is from PTS1.

29. The method, the synthetic peptide shuttle agent, composition, use, or kit of any one of items 24 to 29, wherein said polypeptide cargo is complexed with a DNA and/or RNA molecule.

30. The method, the synthetic peptide shuttle agent, composition, use, or kit of any one of items 24 to 29, wherein said polypeptide cargo is a transcription factor, a nuclease, a cytokine, a hormone, a growth factor, an antibody, a peptide cargo, an enzyme, an enzyme inhibitor, or any combination thereof.

31. The method, the synthetic peptide shuttle agent, composition, use, or kit of item 30, wherein:
 (a) said transcription factor is: HOXB4, NUP98-HOXA9, Oct3/4, Sox2, Sox9, Klf4, c-Myc, MyoD, Pdx1, Ngn3, MafA, Blimp-1, Eomes, T-bet, FOXO3A, NF-YA, SALL4, ISL1, FoxA1, Nanog, Esrrb, Lin28, HIF1-alpha, HIf, Runx1t1, Pbx1, Lmo2, Zfp37, Prdm5, Bcl-6, or any combination thereof;
 (b) said nuclease is a catalytically active or catalytically dead: RNA-guided endonuclease, CRISPR endonuclease, type I CRISPR endonuclease, type II CRISPR endonuclease, type III CRISPR endonuclease, type IV CRISPR endonuclease, type V CRISPR endonuclease, type VI CRISPR endonuclease, CRISPR associated protein 9 (Cas9), Cpf1, CasY, CasX, zinc-finger nuclease (ZFNs), Transcription activator-like effector nucleases (TALENs), homing endonuclease, meganuclease, DNA-guided nuclease, *Natronobacterium gregoryi* Argonaute (NgAgo), or any combination thereof;
 (c) said antibody recognizes an intracellular antigen; and/or
 (d) said peptide cargo recognizes an intracellular molecule.

32. The method, the synthetic peptide shuttle agent, composition, use, or kit of any one of items 24 to 31, for use in cell therapy, genome editing, adoptive cell transfer, and/or regenerative medicine.

33. The method, the synthetic peptide shuttle agent, composition, use, or kit of any one of items 24 to 32, wherein said target eukaryotic cell is an animal cell, a mammalian cell, a human cell, a stem cell, a primary cell, an immune cell, a T cell, an NK cell, or a dendritic cell.

34. A eukaryotic cell comprising the shuttle agent as defined in any one of items 1 to 15, the synthetic peptide shuttle agent as defined in item 18, or the composition as defined in item 21.

35. The eukaryotic cell of item 34, which is an animal cell, a mammalian cell, a human cell, a stem cell, a primary cell, an immune cell, a T cell, an NK cell, or a dendritic cell.

36. A method for delivering one or more CRISPR-associated endonucleases alone or with one or more corresponding guide RNA and/or linear DNA templates, to a target eukaryotic cell, said method comprising contacting the target eukaryotic cell with the endonuclease in the presence of a shuttle agent at a concentration sufficient to increase the transduction efficiency of said endonuclease, as compared to in the absence of said shuttle agent, wherein said shuttle agent is as defined in any one of items 1 to 15.

37. The method of item 36, which is an in vitro method, or an in vivo method.

38. The method of item 36 or 37, wherein said one or more endonuclease is: a type I CRISPR endonuclease, a type II CRISPR endonuclease, a type III CRISPR endonuclease, a type IV CRISPR endonuclease, a type V CRISPR endonuclease, a type VI CRISPR endonuclease, or any combination thereof.

39. The method of item 36 or 37, wherein said one or more endonuclease is CRISPR associated protein 9 (Cas9), Cpf1, CasX, CasY, or any combination thereof; or a catalytically dead CRISPR associated protein 9 (dCas9), dCpf1, dCasX, dCasY, or any combination thereof.

40. The method of any one of items 36 to 39, wherein said target eukaryotic cell is an animal cell, a mammalian cell, a human cell, a stem cell, a primary cell, an immune cell, a T cell, an NK cell, or a dendritic cell.

41. The method of item 58, wherein said one or more corresponding guide RNA and/or linear DNA template targets one or more genes to reduce the immunogenicity, improve cytotoxicity, and/or otherwise improve the effectiveness of the target eukaryotic cell for cell-based therapy, as compared to a corresponding parent eukaryotic cell that has not been subjected to said method.

42. The method of item 41, wherein said cell-based therapy is cell-based cancer immunotherapy.

43. The method of any one of items 40 to 42, wherein said one or more corresponding guide RNA and/or linear DNA template targets the CBLB gene, c-CBL gene, GSK3 gene, ILT2 gene, CISH gene, NKG2a gene, B2M gene, or any combination thereof.

44. A method for producing a synthetic peptide shuttle agent that delivers a polypeptide cargo from an extracellular space to the cytosol and/or nucleus of a target eukaryotic cell, said method comprising synthesizing a peptide which is:
 (1) a peptide at least 20 amino acids in length comprising
 (2) an amphipathic alpha-helical motif having
 (3) a positively-charged hydrophilic outer face, and a hydrophobic outer face,
wherein at least five of the following parameters (4) to (15) are respected:
 (4) the hydrophobic outer face comprises a highly hydrophobic core consisting of spatially adjacent L, I, F, V, W, and/or M amino acids representing 12 to 50% of the amino acids of the peptide, based on an open cylindrical representation of the alpha-helix having 3.6 residues per turn;
 (5) the peptide has a hydrophobic moment ($\mu$) of 3.5 to 11;
 (6) the peptide has a predicted net charge of at least +4 at physiological pH;
 (7) the peptide has an isoelectric point (pI) of 8 to 13;
 (8) the peptide is composed of 35% to 65% of any combination of the amino acids: A, C, G, I, L, M, F, P, W, Y, and V;
 (9) the peptide is composed of 0% to 30% of any combination of the amino acids: N, Q, S, and T;
 (10) the peptide is composed of 35% to 85% of any combination of the amino acids: A, L, K, or R;
 (11) the peptide is composed of 15% to 45% of any combination of the amino acids: A and L, provided there being at least 5% of L in the peptide;
 (12) the peptide is composed of 20% to 45% of any combination of the amino acids: K and R;
 (13) the peptide is composed of 0% to 10% of any combination of the amino acids: D and E;
 (14) the difference between the percentage of A and L residues in the peptide (% A+L), and the percentage of K and R residues in the peptide (K+R), is less than or equal to 10%; and
 (15) the peptide is composed of 10% to 45% of any combination of the amino acids: Q, Y, W, P, I, S, G, V, F, E, D, C, M, N, T, and H.

45. The method of item 44, wherein the peptide is as defined in any one of items 2 to 15.

46. A method for identifying a shuttle agent that delivers a polypeptide cargo from an extracellular space to the cytosol and/or nucleus of a target eukaryotic cell, said method comprising:
 (a) synthesizing a peptide which is the peptide as defined in any one items 1 to 15 or 18;
 (b) contacting the target eukaryotic cell with the polypeptide cargo in the presence of said peptide;
 (c) measuring the transduction efficiency of the polypeptide cargo in the target eukaryotic cell; and
 (d) identifying the peptide as being a shuttle agent that transduces the polypeptide cargo, when an increase in the transduction efficiency of said polypeptide cargo in the target eukaryotic cell is observed.

47. The method of item 46, wherein said polypeptide cargo is as defined in any one of items 24 to 31.

48. A genome editing system comprising:
 (a) the shuttle agent as defined in any one items 1 to 15 or 18;
 (b) one or more CRISPR-associated endonucleases; and
 (c) one or more guide RNAs.

49. The genome editing system of item 48, further comprising a linear DNA template for controlling the genome editing.

50. The genome editing system of item 48 or 49, wherein said one or more CRISPR-associated endonucleases is: a type I CRISPR endonuclease, a type II CRISPR endonuclease, a type III CRISPR endonuclease, a type IV CRISPR endonuclease, a type V CRISPR endonuclease, a type VI CRISPR endonuclease, CRISPR associated protein 9 (Cas9), Cpf1, CasX, CasY, or any combination thereof.

51. A method for enriching eukaryotic cells transduced with a polypeptide cargo of interest, said method comprising:
 (a) co-transducing a target eukaryotic cell population with a polypeptide cargo of interest and a marker protein; and
 (b) isolating or concentrating eukaryotic cells transduced with the marker protein, thereby enriching eukaryotic cells transduced with the polypeptide cargo of interest.

52. The method of item 51, wherein:
 (i) the marker protein is not covalently bound to the polypeptide cargo of interest, the marker protein is covalently bound to the polypeptide cargo of interest, the marker protein is non-covalently bound to the polypeptide cargo of interest, or the marker protein is covalently bound to the polypeptide cargo of interest via a cleavable linker; and/or
 (ii) the marker protein comprises a detectable label, or the marker protein is a fluorescent protein, a fluorescently-labeled protein, a bioluminescent protein, an isotopically-labelled protein, or a magnetically-labeled protein.

53. The method of item 51 or 52, wherein the intracellular concentration of the transduced marker protein is positively correlated with the intracellular concentration of the transduced polypeptide cargo of interest.

54. The method of any one of items 51 to 53, wherein the eukaryotic cells transduced with the marker protein are isolated or concentrated using flow cytometry, fluorescence-activated cell sorting (FACS), or magnetic-activated cell sorting (MACS).

55. The method of any one of items 51 to 54, wherein the eukaryotic cells transduced with the marker protein are isolated or sorted from cells lacking the marker protein, thereby producing a marker protein-positive cell population and/or a marker protein-negative cell population.

56. The method of item 55, further comprising repeating steps (a) and (b), one or more times, on the marker protein-negative cell population, on the marker protein-positive cell population, or on both the marker protein-negative and the marker protein-positive cell populations.

57. The method of any one of items 51 to 56, wherein the eukaryotic cells transduced with the marker protein are isolated or sorted based on their intracellular concentration of the marker protein.

58. The method of any one of items 51 to 57, wherein the marker protein is a protein that stimulates cell proliferation, a protein that stimulates cell differentiation, a protein that promotes cell survival, an anti-apoptotic protein, or a protein having another biological activity.

59. The method of any one of items 51 to 58, wherein the polypeptide cargo of interest and the marker protein are co-transduced by contacting the target eukaryotic cell with the polypeptide cargo and the marker protein in the presence of a peptide transduction agent, wherein the peptide transduction agent is present at a concentration sufficient to increase the transduction efficiency of the polypeptide cargo and the marker protein, as compared to in the absence of said peptide transduction agent.

60. The method of item 59, wherein:
  (a) the peptide transduction agent is an endosomolytic peptide;
  (b) the peptide transduction agent is or comprises the synthetic peptide shuttle agent as defined in item 17 or 18;
  (c) the target eukaryotic cells comprise animal cells, mammalian cells, human cells, stem cells, primary cells, immune cells, T cells, NK cells, or dendritic cells;
  (d) the polypeptide cargo of interest is: (i) the polypeptide cargo as defined in any one of items 24 to 31; and/or (ii) one or more CRISPR-associated endonucleases alone or with one or more corresponding guide RNA and/or linear DNA templates as defined in any one of items 38 to 43; or
  (e) any combination of (a) to (d).

Other objects, advantages and features of the present description will become more apparent upon reading of the following non-restrictive description of specific embodiments thereof, given by way of example only with reference to the accompanying drawings.

EXAMPLES

Example 1

Materials and Methods 1.1 Materials

All chemicals were purchased from Sigma-Aldrich (St. Louis, Mo., USA or Oakville, ON, Canada) or equivalent grade from BioShop Canada Inc. (Mississauga, ON, Canada) or VWR (Ville Mont-Royal, QC, Canada), unless otherwise noted.

1.2 Reagents

TABLE 1.1

Reagents

| Material | Company | City, Province-State, Country |
| --- | --- | --- |
| RPMI 1640 media | Sigma-Aldrich | Oakville, ON, Canada |
| DMEM | Sigma-Aldrich | Oakville, ON, Canada |
| Alpha MEM | Stem Cell Technology | Oakville, ON, Canada |
| Fetal bovine serum (FBS) | NorthBio | Toronto, ON, Canada |
| Horse serum | Invitrogen | Burlington, ON, Canada |
| L-glutamine-Penicillin-Streptomycin | Sigma-Aldrich | Oakville, ON, Canada |
| Trypsin-EDTA solution | Sigma-Aldrich | Oakville, ON, Canada |
| Inositol | Sigma-Aldrich | Oakville, ON, Canada |
| Folic acid | Sigma-Aldrich | Oakville, ON, Canada |
| pEGFP-C1 | CLONTECH Laboratories | Palo Alto, CA, USA |
| FITC-Antibody α-tubulin | Abcam ab64503 | Cambridge, MA, USA |
| ITS | Invitrogen/41400-045 | Burlington, ON, Canada |
| FGF 2 | Feldan Bio/1D-07-017 | Quebec, QC, Canada |
| Dexamethasone | Sigma-Aldrich/D8893 | Oakville, ON, Canada |
| Bovine serum albumin (BSA) | Sigma-Aldrich/A-1933 | Oakville, ON, Canada |
| MB1 media | GE Healthcare HyClone | Logan, Utah, USA |
| Calcein | Sigma-Aldrich/C0875 | Oakville, ON, Canada |
| HisTrap ™ FF column | GE Healthcare | Baie d'Urfe, QC, Canada |
| Q Sepharose ™ | GE Healthcare | Baie d'Urfe, QC, Canada |
| SP Sepharose ™ | GE Healthcare | Baie d'Urfe, QC, Canada |
| Amicon Ultra centrifugal filters | EMD Millipore | Etobicoke, ON Canada |
| Label IT ® Cy ®5 kit | Mirus Bio LLC | Madison, WI, USA |
| Calf serum | NorthBio | Toronto, ON, Canada |
| beta-mercaptoethanol | Sigma-Aldrich or Gibco-ThermoFisher | Oakville, ON, Canada |
| IL-2 | Feldan Bio/rhIL-2 Research | Quebec, QC, Canada |
| Resazurin sodium salt | Sigma-Aldrich/R7017-1G | Oakville, ON, Canada |
| Anti-HOXB4 monoclonal antibody | Novus Bio #NBP2-37257 | Oakville, ON, Canada |
| Alexa ™-594 Anti-Mouse | Abcam #150116 | Toronto, ON, Canada |
| Fluoroshield ™ with DAPI | Sigma #F6057 | Oakville, ON, Canada |
| GFP Monoclonal antibody | Feldan Bio #A017 | Quebec, QC, Canada |
| Phusion ™ High-Fidelity DNA polymerase | (NEB #M0530S) | Whitby, ON, Canada |

TABLE 1.1-continued

| Reagents | | |
|---|---|---|
| Material | Company | City, Province-State, Country |
| Edit-R ™ Synthetic crRNA Positive Controls | (Dharmacon #U-007000-05) | Ottawa, ON, Canada |
| T7 Endonuclease I | (NEB, Cat #M0302S) | Whitby, ON, Canada |
| FastFect ™ transfection reagent | (Feldan Bio #9K-010-0001) | Quebec, QC, Canada |
| Goat Anti-Mouse IgG H&L (Alexa Fluor ®488) | Abcam ab150113 | Toronto, ON, Canada |
| Goat Anti-Rabbit IgG H&L (Alexa Fluor ® 594) | Abcam ab150080 | Toronto, ON, Canada |
| Opti-MEM ™ | Sigma-Aldrich | Oakville, ON, Canada |
| Anti-NUP98 | Abcam #ab50610 | Toronto, ON, Canada |
| PARP (Cleaved) [214/215] Human ELISA Kit | ThermoFisher #KHO0741 | Burlington, ON, Canada |
| Purified Rabbit Anti-Active Caspase-3 | BD Biosciences #559565 | Mississauga, ON, Canada |
| Active Caspace-3 antibody | Cedarlane #AF835 | Burlington, ON, Canada |
| TNF-alpha Antibody | BioVision Inc #3054-100 | Milpitas, CA, USA |
| APC Mouse Anti-Human HLA-ABC | BD Biosciences #555555 | Mississauga, ON, Canada |
| Anti-CD3 | Biolegend#cat: 300438 | San Diego, CA, USA |
| Anti-CD28 | Thermofisher #cat: 16-0289-85 | Burlington, ON, Canada |

1.3 Cell Lines

HeLa, HEK293A, HEK293T, THP-1, CHO, NIH3T3, CA46, Balb3T3, HT2, KMS-12, DOHH2, REC-1, HCC-78, NCI-H196 and HT2 cells were obtained from American Type Culture Collection (Manassas, Va., USA) and cultured following the manufacturer's instructions. Myoblasts are primary human cells kindly provided by Professor J. P. Tremblay (Université Laval, Quebec, Canada).

TABLE 1.2

| Cell lines and culture conditions | | | | | |
|---|---|---|---|---|---|
| Cell lines | Description | ATCC/others | Culture media | Serum | Additives |
| HeLa (adherent cells) | Human cervical carcinoma cells | ATCC ™ CCL-2 | DMEM | 10% FBS | L-glutamine 2 mM Penicillin 100 units Streptomycin 100 µg/mL |
| HEK 293A (adherent cells) | Human embryonic Epithelial kidney cells | ATCC ™ CRL-1573 | DMEM | 10% FBS | L-glutamine 2 mM Penicillin 100 units Streptomycin 100 µg/mL |
| HEK 293T (adherent cells) | Human embryonic Epithelial kidney cells | ATCC ™ CRL-3216 | DMEM | 10% FBS | L-glutamine 2 mM Penicillin 100 units Streptomycin 100 µg/mL |
| THP-1 (suspension cells) | Acute monocytic leukemia | ATCC ™ TIB202 | RPMI 1640 | 10% FBS | β-mercaptoethanol 0.05 mM L-glutamine 2 mM Penicillin 100 units Streptomycin 100 µg/mL |
| Myoblasts (primary adherent cells) | Human (13 months) myoblasts | Kindly provided by Professor J. P. Tremblay | MB1 | 15% FBS | ITS 1x, FGF 2 10 ng/mL, Dexamethasone 0.39 µg/mL, BSA 0.5 mg/mL, MB1 85% |
| CHO (adherent cells) | Chinese hamster ovary cells | ATCC ™ CCL-61 | DMEM | 10% FBS | L-glutamine 2 mM Penicillin 100 units Streptomycin 100 µg/mL |
| NIH3T3 (adherent cells) | Fibroblasts | ATCC ™ CRL-1658 | DMEM | 10% Calf serum | L-glutamine 2 mM Penicillin 100 units Streptomycin 100 µg/mL |
| HT2 (suspension cells) | T lymphocytes | ATCC ™ CRL-1841 | RPMI 1640 | 10% FBS | 200 IU/mL IL-2 β-mercaptoethanol 0.05 mM L-glutamine 2 mM Penicillin 100 units Streptomycin 100 µg/mL |
| CA46 (suspension cells) | *Homo sapiens* Burkitt's lymphoma | ATCC ™ CRL-1648 | RPMI 1640 | 20% FBS | L-glutamine 2 mM Penicillin 100 units Streptomycin 100 µg/mL |
| Balb3T3 (adherent cells) | Fibroblasts | ATCC ™ CCL-163 | DMEM | 10% Calf serum | L-glutamine 2 mM Penicillin 100 units Streptomycin 100 µg/mL |
| Jurkat (suspension cells) | Human T cells | ATCC ™ TIB-152 | RPMI 1640 | 10% FBS | L-glutamine 2 mM Penicillin 100 units Streptomycin 100 µg/mL |
| DOHH2 (suspension cells) | Human B cell lymphoma | Gift from Horizon Inc. | RPMI 1640 | 10% FBS | L-glutamine 2 mM Penicillin 100 units Streptomycin 100 µg/mL |
| KMS-12 (suspension cells) | Myeloma bone marrow | Gift from Horizon Inc. | Advanced RPMI 1640 | 10% FBS | L-glutamine 2 mM Penicillin 100 units Streptomycin 100 µg/mL |

TABLE 1.2-continued

Cell lines and culture conditions

| Cell lines | Description | ATCC/others | Culture media | Serum | Additives |
|---|---|---|---|---|---|
| REC-1 (suspension cells) | Human lymph node mantel cell | Gift from Horizon Inc. | RPMI 1640 | 10% FBS | L-glutamine 2 mM Penicillin 100 units Streptomycin 100 μg/mL |
| HCC-78 (adherent cells) | Human adenocarcinoma lung cell | Gift from Horizon Inc. | RPMI 1640 | 20% FBS | L-glutamine 2 mM Penicillin 100 units Streptomycin 100 μg/mL |
| NCI-H196 (adherent cells) | Human small cell lung cancer | Gift from Horizon Inc. | RPMI 1640 | 10% FBS | L-glutamine 2 mM Penicillin 100 units Streptomycin 100 μg/mL |
| NK (suspension cells) | Human normal Peripheral Blood CD56+ lymphocyte | All cells™ #PB012-PF | RPMI 1640 | 10% FBS | 200 IU/mL IL-2 L-glutamine 2 mM Penicillin 100 units Streptomycin 100 μg/mL |
| NK-92 (suspension cells) | Human normal Peripheral Blood CD56+ lymphocyte | Gift from CETC | Alpha MEM | 12.5% FBS 12.5% Horse serum | L-glutamine 200 nM IL-2 25000 U/mL Inositol 1M Folic acid 100 nM B-ME 55 mM |
| T cells (suspension cells) | Human normal Peripheral Blood CD3+ lymphocyte | Healthy blood donor | RPMI advanced | 10% FBS | L-glutamine 200 nM IL-2 25000 U/mL Penicillin 100 units Streptomycin 100 μg/mL |

FBS: Fetal bovine serum

1.4 Protein Purification

Fusion proteins were expressed in bacteria (*E. coli* BL21DE3) under standard conditions using an isopropyl β-D-1-thiogalactopyranoside (IPTG) inducible vector containing a T5 promoter. Culture media contained 24 g yeast extract, 12 g tryptone, 4 mL glycerol, 2.3 g $KH_2PO_4$, and 12.5 g $K_2HPO_4$ per liter. Bacterial broth was incubated at 37° C. under agitation with appropriate antibiotic (e.g., ampicillin). Expression was induced at optical density (600 nm) between 0.5 and 0.6 with a final concentration of 1 mM IPTG for 3 hours at 30° C. Bacteria were recuperated following centrifugation at 5000 RPM and bacterial pellets were stored at −20° C.

Bacterial pellets were resuspended in Tris buffer (Tris 25 mM pH 7.5, NaCl 100 mM, imidazole 5 mM) with phenylmethylsulfonyl fluoride (PMSF) 1 mM, and lysed by passing 3 times through the homogenizer Panda 2K™ at 1000 bar. The solution was centrifuged at 15000 RPM, 4° C. for 30 minutes. Supernatants were collected and filtered with a 0.22 μM filtration device.

Solubilized proteins were loaded, using a FPLC (AKTA Explorer 100R), on HisTrap™ FF column previously equilibrated with 5 column volumes (CV) of Tris buffer. The column was washed with 30 column volumes (CV) of Tris buffer supplemented with 0.1% Triton™ X-114 followed with 30 CV of Tris buffer with imidazole 40 mM. Proteins were eluted with 5 CV of Tris buffer with 350 mM Imidazole and collected. Collected fractions corresponding to specific proteins were determined by standard denaturing SDS-PAGE.

Purified proteins were diluted in Tris 20 mM at the desired pH according to the protein's pI and loaded on an appropriate ion exchange column (Q Sepharose™ or SP Sepharose™) previously equilibrated with 5 CV of Tris 20 mM, NaCl 30 mM. The column was washed with 10 CV of Tris 20 mM, NaCl 30 mM and proteins were eluted with a NaCl gradient until 1 M on 15 CV. Collected fractions corresponding to specific proteins were determined by standard denaturing SDS-PAGE. Purified proteins were then washed and concentrated in PBS 1× on Amicon Ultra™ centrifugal filters 10,000 MWCO. Protein concentration was evaluated using a standard Bradford assay.

1.5 Synthetic Peptides and Shuttle Agents

All peptides used in this study were purchased from GLBiochem (Shanghai, China) and their purities were confirmed by high-performance liquid chromatography analysis and mass spectroscopy. In some cases, peptides were synthesized to contain a C-terminal cysteine residue to allow the preparation of peptide dimers. These dimeric peptides were directly synthetized with a disulfide bridge between the C-terminal cysteines of two monomers. The amino acid sequences and characteristics of each of the synthetic peptides and shuttle agents tested in the present examples are summarized in Table 1.3, Table B1, and Table C1.

TABLE 1.3

Synthetic peptides and shuttle agents

| Domain(s) | Peptide or Shuttle agent | Amino acid (a.a.) sequence [SEQ ID NO; not including C-terminal Cys, unless indicated with an *] | a.a. | MW (kDa) | pI | Charge | Hydropathicity index |
|---|---|---|---|---|---|---|---|
| ELD | CM18 | KWKLFKKIGAVLKVLTTG [1] | 18 | 2.03 | 10.60 | 5+/0− | 0.350 |
| | C(LLKK)$_3$C | CLLKKLLKKLLKKC [63] | 14 | 1.69 | 10.05 | 6+/0− | 0.314 |
| | LAH4 | KKALLALALHHLAHLALHLALALKKA [6] | 26 | 2.78 | 10.48 | 4+/0− | 0.923 |
| | KALA | WEAKLAKALAKALAKHLAKALAKALKACEA [14] | 30 | 3.13 | 9.9 | 7+/2− | 0.283 |

TABLE 1.3-continued

Synthetic peptides and shuttle agents

| Domain(s) | Peptide or Shuttle agent | Amino acid (a.a.) sequence [SEQ ID NO; not including C-terminal Cys, unless indicated with an *] | a.a. | MW (kDa) | pI | Charge | Hydropathicity index |
|---|---|---|---|---|---|---|---|
| CPD | TAT-cys | YGRKKRRQRRRC [17] | 12 | 1.66 | 12.01 | 8+/0− | −3.125 |
| | Penetratin-cys | RQIKIWFQNRRMKWKKC [18] | 17 | 2.35 | 11.75 | 7+/0− | −1.482 |
| | PTD4 | YARAAARQARA [65] | 11 | 1.2 | 11.72 | 3+/0− | −0.682 |
| His-PTD4 | His-PTD4 | HHHHHHYARAAARQARA [81] | 17 | 2.03 | 11.71 | 3+/0− | −1.57 |
| CPD-ELD | TAT-CM18 | YGRKKRRQRRRCKWKLFKKIGAVLKVLTTG [66] | 30 | 3.68 | 12.02 | 13+/0− | −1.041 |
| | TAT-KALA | YGRKKRRQRRRCWEAKLAKALAKALAKHL AKALAKALKACEA [67] | 42 | 4.67 | 11.46 | 15+/2− | −0.768 |
| | PTD4-KALA | YARAAARQARAWEAKLAKALAKALAKHLAK ALAKALKACEA [82] | 41 | 4.32 | 10.46 | 10+/2− | 0.024 |
| | 9Arg-KALA | RRRRRRRRRWEAKLAKALAKALAKHLAKAL AKALKACEA [83] | 39 | 4.54 | 12.11 | 16+/2− | −0.821 |
| | Pep1-KALA | KETWWETWWTEWSQPKKKRKVWEAKLAK ALAKALAKHLAKALAKALKACEA [84] | 51 | 5.62 | 10.01 | 13+/5− | −0.673 |
| | Xentry-KALA | LCLRPVGWEAKLAKALAKALAKHLAKALAK ALKACEA[85] | 37 | 3.87 | 9.93 | 8+/2− | 0.441 |
| | SynB3-KALA | RRLSYSRRRFWEAKLAKALAKALAKHLAKA LAKALKACEA[86] | 40 | 4.51 | 11.12 | 12+/2− | −0.258 |
| ELD-CPD | CM18-TAT-Cys | KWKLFKKIGAVLKVLTTGYGRKKRRQRRRC [57] | 30 | 3.67 | 12.02 | 13+/0− | −1.04 |
| | CM18-Penetratin-Cys | KWKLEKKIGAVLKVLTTGRQIKIWFQNRRMK WKKC [58] | 35 | 4.36 | 11.36 | 12+/0− | −0.54 |
| | dCM18-TAT-Cys (CM18-TAT-cys dimer) | KWKLFKKIGAVLKVLTTGYGRKKRRQRRRC [57] KWKLFKKIGAVLKVLTTGYGRKKRRQRRRC [57] | 60 | 7.34 | 12.16 | 26+/0− | −1.04 |
| | dCM18-Penetratin-Cys (CM18-Penetratin-Cys dimer) | KWKLFKKIGAVLKVLTTGRQIKIWFQNRRMK WKKC [58] KWKLFKKIGAVLKVLTTGRQIKIWFQNRRMK WKKC [58] | 70 | 8.72 | 12.05 | 24+/0− | −0.54 |
| | VSVG-PTD4 | KFTIVFPHNQKGNWKNVPSNYHYCPYARA AARQARA [87] | 36 | 4.2 | 10.3 | 6+/0− | −0.89 |
| | EB1-PTD4 | LIRLWSHLIHIWFQNRRLKWKKKYARAAR QARA [88] | 34 | 4.29 | 12.31 | 10+/0− | −0.647 |
| | JST-PTD4 | GLFEALLELLESLWELLLEAYARAAARQARA [89] | 31 | 3.49 | 4.65 | 5+/3− | 0.435 |
| | CM18-PTD4 | KWKLFKKIGAVLKVLTTGYARAAARQARA [90] | 29 | 3.217 | 11.76 | 8+/0− | −0.041 |
| | 6Cys-CM18-PTD4 | CCCCCCKWKLFKKIGAVLKVLTTGYARAAA RQARA [91] | 35 | 3.835 | 9.7 | 8+/0− | 0.394 |
| | CM18-L1-PTD4 | KWKLFKKIGAVLKVLTTGGGSYARAAARQA RA [92] | 32 | 3.42 | 11.76 | 8+/0− | −0.087 |
| | CM18-L2-PTD4 | KWKLFKKIGAVLKVLTTGGGSGGGSYARAA ARQARA [93] | 36 | 3.68 | 11.76 | 8+/0− | −0.133 |
| | CM18-L3-PTD4 | KWKLFKKIGAVLKVLTTGGGSGGGSGGGS GYARAAARQARA [94] | 41 | 3.99 | 11.76 | 8+/0− | −0.176 |
| His-ELD-CPD | Met-His-CM18-TAT-Cys | MHHHHHHKWKLFKKIGAVLKVLTTGYGRKK RRQRRRC [59*] | 37 | 4.63 | 12.02 | 13+/0− | −1.311 |
| | His-CM18-TAT | HHHHHHKWKLFKKIGAVLKVLTTGYGRKKR RQRRR [95] | 35 | 4.4 | 12.31 | 13+/0− | −1.208 |
| | His-CM18-PTD4 | HHHHHHKWKLFKKIGAVLKVLTTCYARAAA RQARA [68] | 35 | 4.039 | 11.76 | 8+/0− | −0.583 |
| | His-CM18-PTD4-6Cys | HHHHHHKWKLFKKIGAVLKVLTTGYARAAA RQARACCCCCC [96*] | 41 | 4.659 | 9.7 | 8+/0− | −0.132 |
| | His-CM18-9Arg | HHHHHHKWKLFKKIGAVLKVLTTGRRRRRR RRR [69] | 33 | 4.26 | 12.91 | 14+/0− | −1.618 |
| | His-CM18-Transportan | HHHHHHKWKLFKKIGAVLKVLTTGGWTLNS AGYLLKINLKALAALAKKIL [70] | 50 | 5.62 | 10.6 | 9+/0− | 0.092 |
| | His--PTD4 | HHHHHHKKALLALALHHLAHLALHLALALKK AYARAAARQARA [71] | 43 | 4.78 | 11.75 | 7+/0− | −0.63 |
| | His-C(LLKK)3C-PTD4 | HHHHHHCLLKKLLKKLLKKCYARAAARQAR A [72] | 31 | 3.56 | 11.21 | 9+/0− | −0.827 |
| | 3His-CM18-PTD4 | HHHKWKLFKKIGAVLKVLTTGYARAAARQA RA [97] | 32 | 3.63 | 11.76 | 8+/0− | −0.338 |
| | 12His-CM18-PTD4 | HHHHHHHHHHHHKWKLFKKIGAVLKVLTTG YARAAARQARA [98] | 41 | 4.86 | 11.78 | 8+/0− | −0.968 |

TABLE 1.3-continued

Synthetic peptides and shuttle agents

| Domain(s) | Peptide or Shuttle agent | Amino acid (a.a.) sequence [SEQ ID NO; not including C-terminal Cys, unless indicated with an *] | a.a. | MW (kDa) | pI | Charge | Hydropathicity index |
|---|---|---|---|---|---|---|---|
| | HA-CM18-PTD4 | HHHAHHHKWKLFKKIGAVLKVLTTGYARAA ARQARA [99] | 36 | 4.11 | 11.76 | 8+/0- | -0.517 |
| | 3HA-CM18-PTD4 | HAHHAHHAHKWKLFKKIGAVLKVLTTGYAR AAARQARA [100] | 38 | 4.25 | 11.78 | 8+/0- | -0.395 |
| ELD-His-CPD | CM18-His-PTD4 | KWKLFKKIGAVLKVLTTGHHHHHHYARAAA RQARA [101] | 35 | 4.04 | 11.76 | 8+/0- | -0.583 |
| His-ELD-CPD-His | His-CM18-PTD4-His | HHHHHHKWKLFKKIGAVLKVLTTGYARAAA RQARAHHHHHH [102] | 41 | 4.86 | 11.76 | 8+/0- | -0.966 |

Results computed using the ProtParam ™ online tool available from ExPASy ™ Bioinformatics Resource Portal (http://web.expasy.org/protparam/)
MW: Molecular weight
pI: Isoelectric point
Charge: Total number of positively (+) and negatively (−) charged residues Example 2

Peptide Shuttle Agents Facilitate Escape of Endosomally-Trapped Calcein 2.1 Endosome Escape Assays Microscopy-based and flow cytometry-based fluorescence assays were developed to study endosome leakage and to determine whether the addition of the shuttle agents facilitates endosome leakage of the polypeptide cargo. These methods are described in Example 2 of PCT/CA2016/050403.

2.1.1 Endosomal Leakage Visualization by Microscopy

Calcein is a membrane-impermeable fluorescent molecule that is readily internalized by cells when administered to the extracellular medium. Its fluorescence is pH-dependent and calcein self-quenches at higher concentrations. Once internalized, calcein becomes sequestered at high concentrations in cell endosomes and can be visualized by fluorescence microscopy as a punctate pattern. Following endosomal leakage, calcein is released to the cell cytoplasm and this release can be visualized by fluorescence microscopy as a diffuse pattern.

One day before the calcein assay was performed, cells in exponential growth phase were harvested and plated in a 24-well plate (80,000 cells per well). The cells were allowed to attach by incubating overnight in appropriate growth media, as described in Example 1. The next day, the media was removed and replaced with 300 μL of fresh media without FBS containing 62.5 μg/mL (100 μM) of calcein, except for HEK293A (250 μg/mL, 400 μM). At the same time, the shuttle agent(s) to be tested was added at a predetermined concentration. The plate was incubated at 37° C. for 30 minutes. The cells were washed with 1×PBS (37° C.) and fresh media containing FBS was added. The plate was incubated at 37° C. for 2.5 hours. The cells were washed three times and were visualized by phase contrast and fluorescence microscopy (IX81™, Olympus).

Figure 1A:
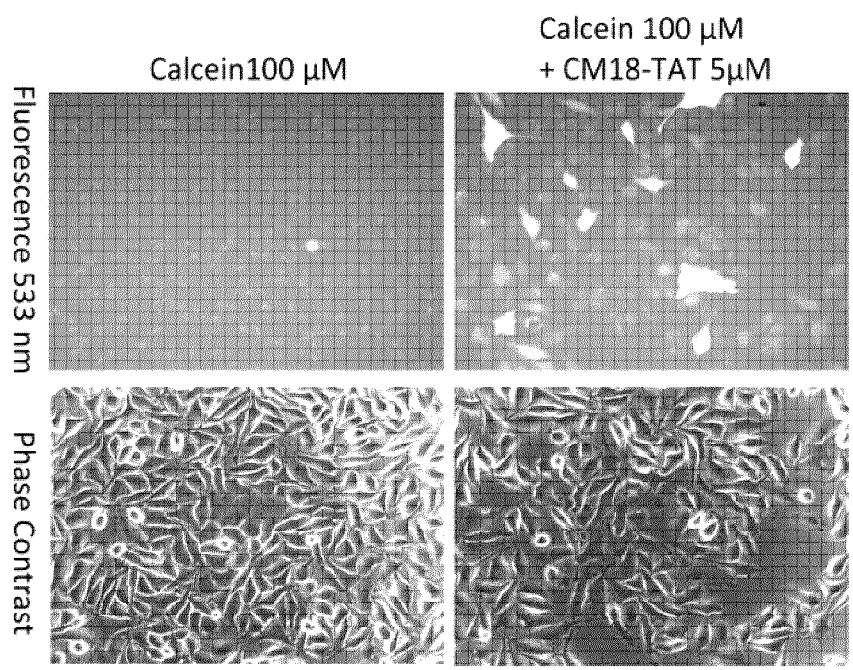
FIGS. 1A and 1B show a typical result of a calcein endosomal escape assay in which HEK293A cells were loaded with the fluorescent dye calcein ("100 µM calcein"), and were then treated (or not) with a shuttle agent that facilitates endosomal escape of the calcein ("100 µM calcein+CM18-TAT 5 µM").

A typical result is shown in FIG. 1A, in which untreated HEK293A cells loaded with calcein ("100 μM calcein") show a low intensity, punctate fluorescent pattern when visualized by fluorescence microscopy (upper left panel). In contrast, HeLa cells treated with a shuttle agent that facilitates endosomal escape of calcein ("100 μM calcein+CM18-TAT 5 μM") show a higher intensity, more diffuse fluorescence pattern in a greater proportion of cells (upper right panel).

2.1.2 Endosomal Leakage Quantification by Flow Cytometry

In addition to microscopy, flow cytometry allows a more quantitative analysis of the endosomal leakage as the fluorescence intensity signal increases once the calcein is released in the cytoplasm. Calcein fluorescence is optimal at physiological pH (e.g., in the cytosol), as compared to the acidic environment of the endosome.

One day before the calcein assay was performed, cells in exponential growth phase were harvested and plated in a 96-well plate (20,000 cells per well). The cells were allowed to attach by incubating overnight in appropriate growth media, as described in Example 1. The next day, the media in wells was removed and replaced with 50 μL of fresh media without serum containing 62.5 μg/mL (100 μM) of calcein, except for HEK293A (250 μg/mL, 400 μM). At the same time, the shuttle agent(s) to be tested was added at a predetermined concentration. The plate was incubated at 37° C. for 30 minutes. The cells were washed with 1×PBS (37° C.) and fresh media containing 5-10% serum was added. The plate was incubated at 37° C. for 2.5 hours. The cells were washed with 1×PBS and detached using trypsinization. Trypsinization was stopped by addition of appropriate growth media, and calcein fluorescence was quantified using flow cytometry (Accuri C6, Becton, Dickinson and Company (BD)).

Untreated calcein-loaded cells were used as a control to distinguish cells having a baseline of fluorescence due to endosomally-trapped calcein from cells having increased fluorescence due to release of calcein from endosomes. Fluorescence signal means ("mean counts") were analyzed for endosomal escape quantification. In some cases, the "Mean Factor" was calculated, which corresponds to the fold-increase of the mean counts relative to control (untreated calcein-loaded cells). Also, the events scanned by flow cytometry corresponding to cells (size and granularity) were analyzed. The cellular mortality was monitored with the percentage of cells in the total events scanned. When it became lower than the control, it was considered that the number of cellular debris was increasing due to toxicity and the assay was discarded.

Figure 1B:
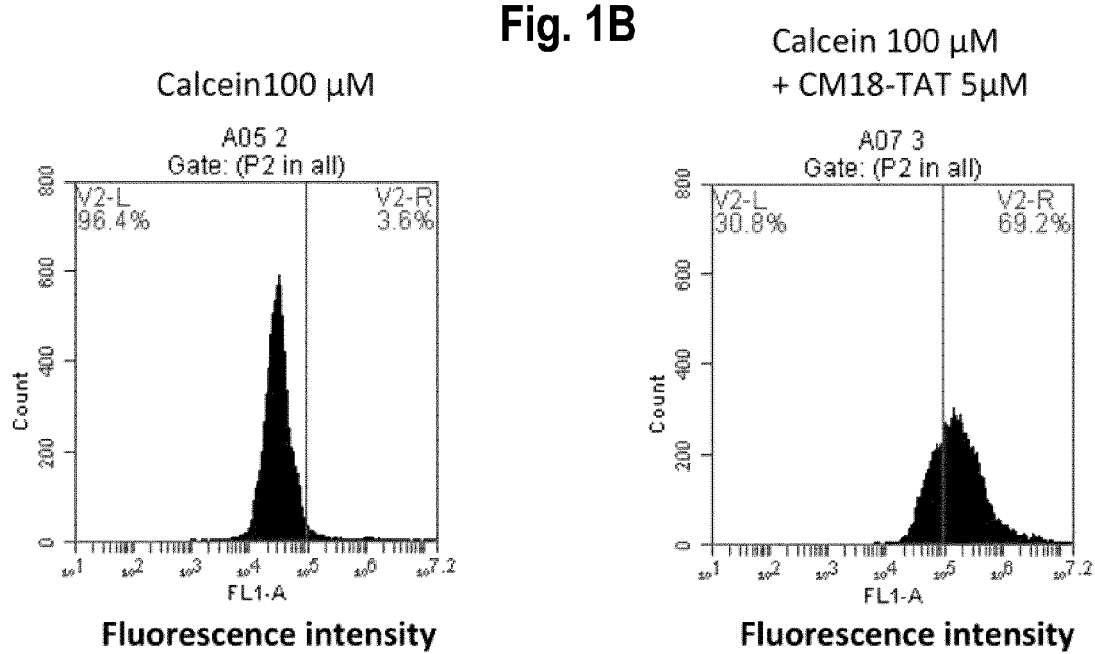

A typical result is shown in FIG. 1B, in which an increase in fluorescence intensity (right-shift) is observed for calcein-loaded HeLa cells treated with a shuttle agent that facilitates endosomal escape ("Calcein 100 μM+CM18-TAT 5 μM", right panel), as compared to untreated calcein-loaded HeLa cells ("Calcein 100 μM", left panel). The increase in calcein fluorescence is caused by the increase in pH associated with the release of calcein from the endosome (acidic) to the cytoplasm (physiological).

2.2 Results from Endosome Escape Assays
2.2.1 HeLa Cells

HeLa cells were cultured and tested in the endosomal escape assays as described in Example 2.1. The results of flow cytometry analyses are summarized below. In each case, the flow cytometry results were also confirmed by fluorescence microscopy (data not shown).

TABLE 2.1

CM18-Penetratin-Cys v. Controls in Hela cells

| Domains | Peptide | Cells | Concentration (μm) | Mean Counts (±St Dev.: n = 3) | Mean Factor |
|---|---|---|---|---|---|
| — | No peptide | HeLa | 0 | 55 359 ± 6844 | 1.0 |
| ELD | CM18 | HeLa | 5 | 46 564 ± 9618 | 0.8 |

TABLE 2.1-continued

CM18-Penetratin-Cys v. Controls in Hela cells

| Domains | Peptide | Cells | Concentration (μm) | Mean Counts (±St Dev.: n = 3) | Mean Factor |
|---|---|---|---|---|---|
| CPD | TAT-Cys | HeLa | 5 | 74 961 ± 9337 | 1.3 |
| | Penetratin-Cys | HeLa | 5 | 59 551 ± 7119 | 1.1 |
| ELD + CPD | CM18 + TAT-Cys | HeLa | 5 + 5 | 64 333 ± 6198 | 1.2 |
| | CM18 + Penetratin-Cys | HeLa | 5 + 5 | 40 976 ± 8167 | 0.7 |
| ELD – CPD | CM18 – Penetratin-Cys | HeLa | 5 | 262 066 ± 28 146 | 4.7 |

TABLE 2.2

CM18-TAT-Cys v. Control in HeLa cells

| Domains | Peptide | Cells | Concentration (μM) | Mean counts (n = 3) | Stand. dev. | Mean Factor |
|---|---|---|---|---|---|---|
| — | No peptide | HeLa | 0 | 53 369 | 4192 | 1.0 |
| ELD-CPD | CM18-TAT-Cys | HeLa | 5 | 306 572 | 46 564 | 5.7 |

The results in Tables 2.1 and 2.2 show that treating calcein-loaded HeLa cells with the shuttle agents CM18-Penetratin-Cys and CM18-TAT-Cys (having the domain structure ELD-CPD) results in increased mean cellular calcein fluorescence intensity, as compared to untreated control cells or cells treated with single-domain peptides used alone (CM18, TAT-Cys, Penetratin-Cys) or together (CM18+TAT-Cys, CM18+Penetratin-Cys). These results suggest that CM18-Penetratin-Cys and CM18-TAT-Cys facilitate escape of endosomally-trapped calcein, but that single domain peptides (used alone or together) do not.

TABLE 2.3

Figure 2:
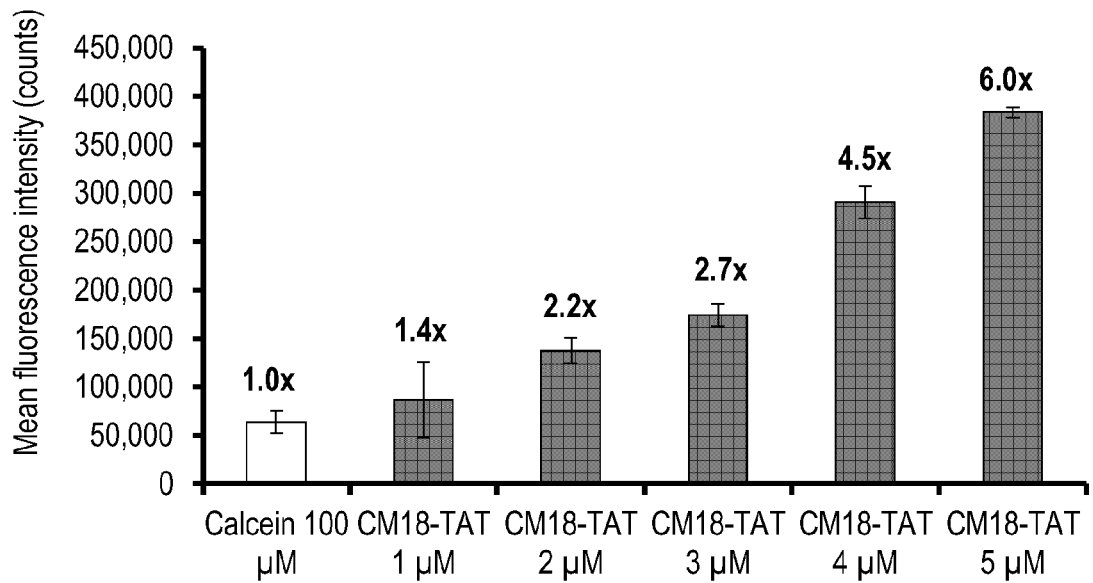
FIG. 2 shows the results of a calcein endosomal escape flow cytometry assay in which HeLa cells were loaded with calcein ("calcein 100 µM"), and were then treated with increasing concentrations of the shuttle agent CM18-TAT-Cys (labeled "CM18-TAT").

Dose response of CM18-TAT-Cys in HeLa cells, data from FIG. 2

| Domains | Peptide | Cells | Concentration (μM) | Mean counts (n = 3) | Stand. dev. | Mean Factor |
|---|---|---|---|---|---|---|
| — | No peptide ("calcein 100 μM") | HeLa | 0 | 63 872 | 11 587 | 1.0 |
| ELD-CPD | CM18-TAT-Cys | HeLa | 1 | 86 919 | 39 165 | 1.4 |
| | CM18-TAT-Cys | HeLa | 2 | 137 887 | 13 119 | 2.2 |
| | CM18-TAT-Cys | HeLa | 3 | 174 327 | 11 519 | 2.7 |
| | CM18-TAT-Cys | HeLa | 4 | 290 548 | 16 593 | 4.5 |
| | CM18-TAT-Cys | HeLa | 5 | 383 685 | 5578 | 6.0 |

TABLE 2.4

Dose response of CM18-TAT-Cys in HeLa cells

| Domains | Peptide | Cells | Concentration (μM) | Mean counts (n = 3) | Stand. dev. | Mean Factor |
|---|---|---|---|---|---|---|
| — | No peptide | HeLa | 0 | 81 013 | 14 213 | 1.0 |
| ELD-CPD | CM18-TAT-Cys | HeLa | 3 | 170 652 | 63 848 | 2.1 |
| | CM18-TAT-Cys | HeLa | 4 | 251 799 | 33 880 | 3.1 |
| | CM18-TAT-Cys | HeLa | 5 | 335 324 | 10 651 | 4.1 |

TABLE 2.5

Figure 3:
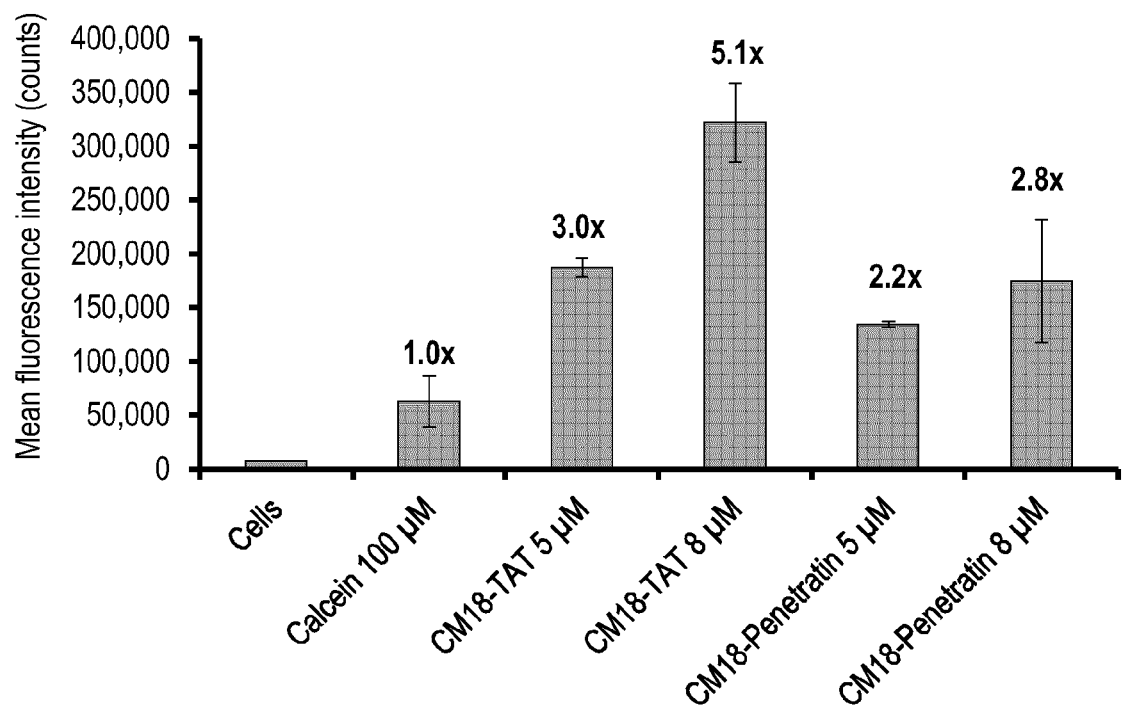
FIGS. 3 and 4 show the results of calcein endosomal escape flow cytometry assays in which HeLa cells (FIG. 3) or primary myoblasts (FIG. 4) were loaded with calcein ("calcein 100 µM"), and were then treated with 5 µM or 8 µM of the shuttle agents CM18-TAT-Cys or CM18-Penetratin-Cys (labeled "CM18-TAT" and "CM18-Penetratin", respectively).

Dose response of CM18-TAT-Cys and CM18-Penetratin-Cys in HeLa cells, data from FIG. 3

| Domains | Peptide | Cells | Concentration (μM) | Mean counts (n = 3) | Stand. dev. | Mean Factor |
|---|---|---|---|---|---|---|
| — | No peptide | HeLa | 0 | 62 503 | 23 752 | 1.0 |
| ELD-CPD | CM18-TAT-Cys | HeLa | 5 | 187 180 | 8593 | 3.0 |
| | CM18-TAT-Cys | HeLa | 8 | 321 873 | 36 512 | 5.1 |
| | CM18-Penetratin-Cys | HeLa | 5 | 134 506 | 2992 | 2.2 |
| | CM18-Penetratin-Cys | HeLa | 8 | 174 233 | 56 922 | 2.8 |

The results in Tables 2.3 (FIG. 2), 2.4, and 2.5 (FIG. 3) suggest that CM18-TAT-Cys and CM18-Penetratin-Cys facilitate escape of endosomally-trapped calcein in HeLa cells in a dose-dependent manner. In some cases, concentrations of CM18-TAT-Cys or CM18-Penetratin-Cys above 10 μM were associated with an increase in cell toxicity in HeLa cells.

TABLE 2.6

Dimers v. monomers of CM18-TAT-Cys and CM18-Penetratin-Cys in HeLa cells

| Domains | Peptide | Cells | Concentration (μM) | Mean counts (n = 4) | Stand. dev. | Mean Factor |
|---|---|---|---|---|---|---|
| — | No peptide | HeLa | 0 | 60 239 | 9860 | 1.0 |
| ELD-CPD | CM18-TAT-Cys | HeLa | 4 | 128 461 | 25 742 | 2.1 |
| | CM18-Penetratin-Cys | HeLa | 4 | 116 873 | 3543 | 1.9 |
| ELD-CPD dimer | dCM18-TAT-Cys | HeLa | 2 | 79 380 | 4297 | 1.3 |
| | dCM18-Penetratin-Cys | HeLa | 2 | 128 363 | 8754 | 2.1 |

TABLE 2.7

Monomers v. dimers of CM18-TAT-Cys and CM18-Penetratin-Cys in HeLa cells

| Domains | Peptide | Cells | Concentraton (μM) | Mean counts (n = 3) | Stand. dev. | Mean Factor |
|---|---|---|---|---|---|---|
| — | No peptide | HeLa | 0 | 55 834 | 1336 | 1.0 |
| ELD-CPD | CM18-TAT-Cys | HeLa | 4 | 159 042 | 16 867 | 2.8 |
| ELD-CPD dimer | dCM18-TAT-Cys | HeLa | 2 | 174 274 | 9 553 | 3.1 |

TABLE 2.8

CM18-TAT-Cys in HEK293A cells

| Domains | Peptide | Cells | Concentration (μM) | Mean counts (n = 2) | Stand. dev. | Mean Factor |
|---|---|---|---|---|---|---|
| — | No peptide | HEK293A | 0 | 165 819 | 7693 | 1.0 |
| ELD-CPD | CM18-TAT-Cys | HEK293A | 0.5 | 196 182 | 17 224 | 1.2 |
| | CM18-TAT-Cys | HEK293A | 5 | 629 783 | 1424 | 3.8 |

The results in Table 2.6 and 2.7 suggest that shuttle peptide dimers (which are molecules comprising more than one ELD and CPD) are able to facilitate calcein endosomal escape levels that are comparable to the corresponding monomers.

2.2.3 HEK293A Cells

To examine the effects of the shuttle agents on a different cell line, HEK293A cells were cultured and tested in the endosomal escape assays as described in Example 2.1. The results of flow cytometry analyses are summarized below in Table 2.8 and in FIG. 1B.

The results in Table 2.8 and in FIG. 1B show that treating calcein-loaded HEK293A cells with the shuttle agent CM18-TAT-Cys results in increased mean cellular calcein fluorescence intensity, as compared to untreated control cells.

2.2.2 Myoblasts

To examine the effects of the shuttle agents on primary cells, primary myoblast cells were cultured and tested in the endosomal escape assays as described in Example 2.1. The results of flow cytometry analyses are summarized below in Tables 2.9 and 2.10, and in FIG. 4. In each case, the flow cytometry results were also confirmed by fluorescence microscopy.

TABLE 2.9

Figure 4:
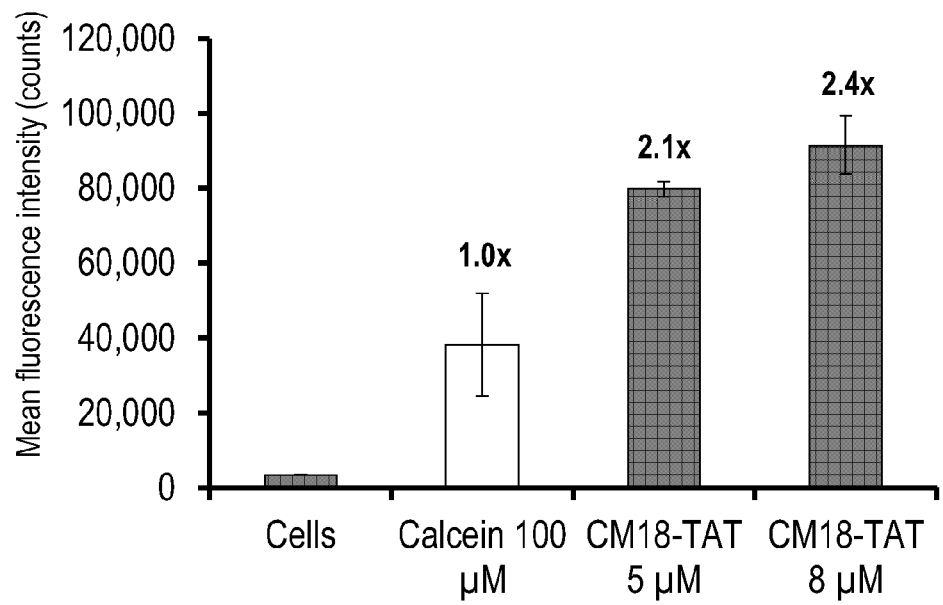

Dose response of CM18-TAT-Cys in primary myoblasts, data from FIG. 4

| Domains | Peptide | Cells | Peptide Conc. (μM) | Mean counts (n = 3) | Stand. dev. | Mean Factor |
|---|---|---|---|---|---|---|
| — | No peptide; no calcein ("Cells") | Myoblasts | 0 | 863 | 61 | n/a |
| — | No peptide ("Calcein 100 μM") | Myoblasts | 0 | 38 111 | 13 715 | 1.0 |
| ELD-CPD | CM18-TAT-Cys | Myoblasts | 5 | 79 826 | 12 050 | 2.1 |
|  | CM18-TAT-Cys | Myoblasts | 8 | 91 421 | 10 846 | 2.4 |

TABLE 2.10

Dose response of CM18-TAT-Cys in primary myoblasts

| Domains | Peptide | Cells | Peptide Conc. (μM) | Mean counts (n = 3) | Stand. dev. | Mean Factor |
|---|---|---|---|---|---|---|
| — | No peptide | Myoblasts | 0 | 31 071 | 21 075 | 1.0 |
| ELD-CPD | CM18-TAT-Cys | Myoblasts | 5 | 91 618 | 10 535 | 2.9 |
|  | CM18-TAT-Cys | Myoblasts | 7.5 | 95 289 | 11 266 | 3.1 |

The results in Table 2.9 (shown graphically in FIG. 4) and Table 2.10 suggest that CM18-TAT-Cys facilitates escape of endosomally-trapped calcein in a dose-dependent manner in primary myoblasts. Concentrations of CM18-TAT-Cys above 10 μM were associated with an increase in cell toxicity in myoblast cells, as for HeLa cells.

TABLE 2.11

Monomers v. dimers CM18-TAT-Cys and CM18-Penetratin-Cys in primary myoblasts

| Domains | Peptide | Cells | Concentration (μM) | Mean counts | Stand. dev. | Mean Factor |
|---|---|---|---|---|---|---|
| — | No peptide | Myoblasts | 0 | 30 175 | 4687 | 1.0 |
| ELD-CPD | CM18-TAT-Cys | Myoblasts | 5 | 88 686 | 19 481 | 2.9 |
| ELD-CPD dimer | dCM18-TAT-Cys | Myoblasts | 2.5 | 64 864 | 1264 | 2.1 |
| ELD-CPD | CM18-Penetratin-Cys | Myoblasts | 5 | 65 636 | 3288 | 2.2 |
| ELD-CPD dimer | dCM18-Penetratin-Cys | Myoblasts | 2.5 | 71 547 | 10 975 | 2.4 |

The results in Table 2.11 suggest that shuttle peptide dimers are able to facilitate calcein endosomal escape levels that are comparable to the corresponding monomers in primary myoblasts.

Example 3

Peptide Shuttle Agents Increase GFP Transduction Efficiency 3.1 Protein Transduction Assay One day before the transduction assay was performed, cells in exponential growth phase were harvested and plated in a 96-well plate (20,000 cells per well). The cells were incubated overnight in appropriate growth media containing FBS (see Example 1). The next day, in separate sterile 1.5 mL tubes, cargo protein at the indicated concentration was pre-mixed (pre-incubated) for 1 or 10 min (depending on the protocol) at 37° C. with the peptide(s) to be tested shuttle agents (0.5 to 5 μM) in 50 μL of fresh medium without serum (unless otherwise specified). The media in wells was removed and the cells were washed three times with freshly prepared phosphate buffered saline (PBS) previously warmed at 37° C. The cells were incubated with the cargo protein/shuttle agent mixture at 37° C. for the indicated time (e.g., 1, 5 or 60 min). After the incubation, the cells were quickly washed three times with freshly prepared PBS and/or heparin (0.5 mg/mL) previously warmed at 37° C. The washes with heparin were required for human THP-1 blood cells to avoid undesired cell membrane-bound protein background in subsequent analyses (microscopy and flow cytometry). The cells were finally incubated in 50 μL of fresh medium with serum at 37° C. before analysis.

3.1a Protocol A: Protein Transduction Assay for Adherent Cells

One day before the transduction assay was performed, cells in exponential growth phase were harvested and plated in a 96-well plate (20,000 cells per well). The cells were incubated overnight in appropriate growth media containing serum (see Example 1). The next day, in separate sterile 1.5-mL tubes, peptides were diluted in sterile distilled water at room temperature (if the cargo is or comprised a nucleic acid, nuclease-free water was used). Cargo protein(s) were then added to the peptides and, if necessary, sterile PBS or cell culture medium (serum-free) was added to obtain the desired concentrations of shuttle agent and cargo in a sufficient final volume to cover the cells (e.g., 10 to 100 μL per well for a 96-well plate). The peptides/cargo mixture was then immediately used for experiments. At least three controls were included for each experiment, including: (1) peptides alone (e.g., at highest concentration tested); (2) cargo alone; and (3) without any cargo or shuttle agent. The media in wells was removed, cells were washed once with PBS previously warmed at 37° C., and the cells were incubated with the cargo protein/peptide mixture at 37° C. for the desired length of time. The peptide/cargo mixture in wells was removed, the cells were washed once with PBS, and fresh complete medium was added. Before analysis, the cells were washed once with PBS one last time and fresh complete medium was added.

3.1b Protocol B: Protein Transduction Assay for Suspension Cells

One day before the transduction assay was performed, suspension cells in exponential growth phase were harvested and plated in a 96-well plate (20,000 cells per well). The cells were incubated overnight in appropriate growth media containing serum (see Example 1). The next day, in separate sterile 1.5-mL tubes, peptides were diluted in sterile distilled water at room temperature (if the cargo is or comprised a nucleic acid, nuclease-free water was used). Cargo protein(s) were then added to the peptides and, if necessary, sterile PBS or cell culture medium (serum-free) was added to obtain the desired concentrations of shuttle agent and cargo in a sufficient final volume to resuspend the cells (e.g., 10 to 100 µL per well in a 96-well plate). The shuttle agent/peptide was then immediately used for experiments. At least three controls were included for each experiment, including: (1) peptide alone (e.g., at highest concentration tested); (2) cargo alone; and (3) without any cargo or shuttle agent. The cells were centrifuged for 2 minutes at 400 g, the medium was then removed and the cells were resuspended in PBS previously warmed at 37° C. The cells were centrifuged again 2 minutes at 400 g, the PBS removed, and the cells were resuspended with the cargo protein/peptide mixture at 37° C. for the desired length of time. After that, 200 µL of complete medium was added directly on the cells. Cells were centrifuged for 2 minutes at 400 g and the medium was removed. The pellet was resuspended and washed in 200 µL of PBS previously warmed at 37° C. After another centrifugation, the PBS was removed and the cells were resuspended in 50 µL of trypsin-EDTA solution for 2 min. 200 of complete medium was directly added and cells were centrifuged for 2 minutes at 400 g. The medium was removed and the cells were resuspended in 200 µL of complete medium.

3.2 Fluorescence Microscopy Analysis

The delivery of fluorescent protein cargo in cytosolic and nuclear cell compartments was observed with an Olympus IX70™ microscope (Japan) equipped with a fluorescence lamp (Model U-LH100HGAPO) and different filters. The Olympus filter U-MF2™ (C54942-Exc495/Em510) was used to observe GFP and FITC-labeled antibody fluorescent signals. The Olympus filter HQ-TR™ (V-N41004-Exc555-60/Em645-75) was used to observe mCherry™ and GFP antibody fluorescent signals. The Olympus filter U-MWU2™ (Exc330/Em385) was used to observe DAPI or Blue Hoechst fluorescent signals. The cells incubated in 50 µL of fresh medium were directly observed by microscopy (Bright-field and fluorescence) at different power fields (4× to 40×). The cells were observed using a CoolSNAP-PRO™ camera (Series A02D874021) and images were acquired using the Image-Proplus™ software.

3.2a Cell Immuno-Labelling

Adherent cells were plated on a sterile glass strip at $1.5 \times 10^5$ cells per well in a 24-plate well and incubated overnight at 37° C. For fixation, cells were incubated in 500 µL per well of formaldehyde (3.7% v/v) for 15 minutes at room temperature, and washed 3 times for 5 minutes with PBS. For permeabilization, cells were incubated in 500 µL per well of Triton™ X-100 (0.2%) for 10 minutes at room temperature, and washed 3 times for 5 minutes with PBS. For blocking, cells were incubated in 500 µL per well of PBS containing 1% BSA (PBS/BSA) for 60 minutes at room temperature. Primary mouse monoclonal antibody was diluted PBS/BSA (1%). Cells were incubated in 30 µL of primary antibody overnight at 4° C. Cells were washed 3 times for 5 minutes with PBS. Secondary antibody was diluted in PBS/BSA (1%) and cells were incubated in 250 µL of secondary antibody 30 minutes at room temperature in the dark. Cells were washed 3 times for 5 minutes with PBS. Glass strips containing the cells were mounted on microscope glass slides with 10 µL of the mounting medium Fluoroshield™ with DAPI.

3.3 Flow Cytometry Analysis:

The fluorescence of GFP was quantified using flow cytometry (Accuri C6, Becton, Dickinson and Company (BD)). Untreated cells were used to establish a baseline in order to quantify the increased fluorescence due to the internalization of the fluorescent protein in treated cells. The percentage of cells with a fluorescence signal above the maximum fluorescence of untreated cells, "mean %" or "Pos cells (%)", is used to identify positive fluorescent cells. "Relative fluorescence intensity (FL1-A)" corresponds to the mean of all fluorescence intensities from each cell with a fluorescent signal after fluorescent protein delivery with the shuttle agent. Also, the events scanned by flow cytometry corresponding to cells (size and granularity) were analyzed. The cellular toxicity (% cell viability) was monitored comparing the percentage of cells in the total events scanned of treated cells comparatively to untreated cells.

3.3a Viability Analysis

Where indicated, the viability of cells was assessed with a resazurin test. Resazurin is a sodium salt colorant that is converted from blue to pink by mitochondrial enzymes in metabolically active cells. This colorimetric conversion, which only occurs in viable cells, can be measured by spectroscopy analysis in order to quantify the percentage of viable cells. The stock solution of resazurin was prepared in water at 1 mg/100 mL and stored at 4° C. 25 µL of the stock solution was added to each well of a 96-well plate, and cells were incubated at 37° C. for one hour before spectrometry analysis. The incubation time used for the resazurin enzymatic reaction depended on the quantity of cells and the volume of medium used in the wells.

3.4 Construction and Amino Acid Sequence of GFP

The GFP-encoding gene was cloned in a T5 bacterial expression vector to express a GFP protein containing a 6× histidine tag and a serine/glycine rich linker in the N-terminal end, and a serine/glycine rich linker and a stop codon (−) at the C-terminal end. Recombinant GFP protein was purified as described in Example 1.4. The sequence of the GFP construct was:

```
                                          [SEQ ID NO: 60]
MHHHHHHGGGSGGGGSGGASTGTGIRMVSKGEELFTGVVPILVELDGDVN

GHKFSVSGEGEGDATYGKLTLKFICTTGKLPVPWPTLVTTLTYGVQCFSRY

PDHMKQHDFFKSAMPEGYVQERTIFFKDDGNYKTRAEVKFEGDTLVNRIEL

KGIDFKEDGNILGHKLEYNYNSHNVYIMADKQKNGIKVNFKIRHNIEDGSV

QLADHYQQNTPIGDGPVLLPDNHYLSTQSALSKDPNEKRDHMVLLEFVTAA

GITLGMDELYKGGSGGGSGGGSGWIRASSGGREIS-
(MW = 31.46 kDa; pI = 6.19)
Serine/glycine rich linkers are in bold
GFP sequence is underlined
```

3.5 GFP Transduction by CM18-TAT-Cys in HeLa Cells: Fluorescence Microscopy

Figure 5:
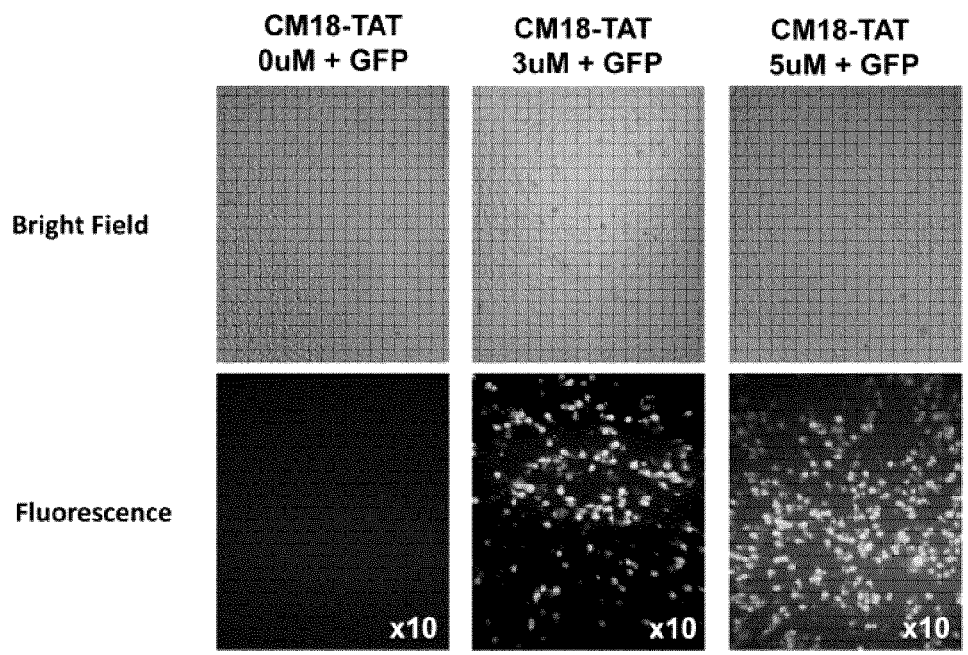
FIG. 5 shows the results of a GFP transduction experiment visualized by fluorescence microscopy in which a GFP cargo protein was co-incubated with 0, 3 or 5 µM of CM18-TAT-Cys (labeled "CM18-TAT"), and then exposed to HeLa cells. The cells were observed by bright field (upper panels) and fluorescence microscopy (lower panels).

HeLa cells were cultured and tested in the protein transduction assay described in Example 3.1. Briefly, GFP recombinant protein was co-incubated with 0, 3 or 5 µM of CM18-TAT, and then exposed to HeLa cells for 1 hour. The cells were observed by bright field and fluorescence microscopy as described in Example 3.2. The results presented in FIG. 5 show that GFP was delivered intracellularly to HeLa cells in the presence of the shuttle agent CM18-TAT.

3.6 GFP Transduction by Shuttle Agents in HeLa Cells: Dose Responses (CM18-TAT-Cys, dCM18-TAT-Cys, GFP) and Cell Viability HeLa cells were cultured and tested in the protein transduction assay described in Examples 3.1-3.3. Briefly, GFP recombinant protein was co-incubated with different concentrations of CM18-TAT-Cys or dimerized CM18-TAT-Cys (dCM18-TAT-Cys), and then exposed to HeLa cells for 1 hour. The results are shown in Table 3.1 and FIGS. 6A-6B.

TABLE 3.1

Figure 6A:
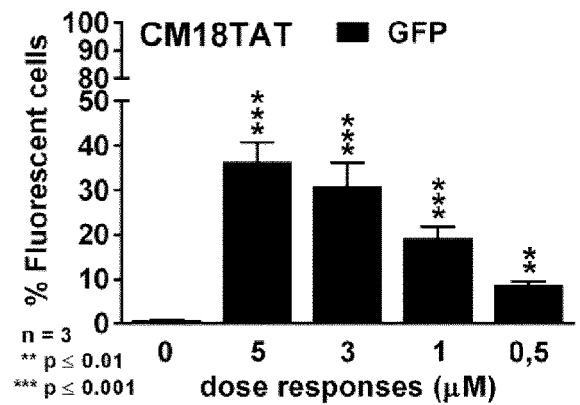
FIGS. 6A and 6B show the results of a GFP transduction efficiency experiment in which GFP cargo protein (10 µM) was co-incubated with different concentrations of CM18-TAT-Cys (labeled "CM18-TAT"), prior to being exposed to HeLa cells. Cells were evaluated by flow cytometry and the percentage of fluorescent (GFP-positive) cell is shown in FIG. 6A, and corresponding cell toxicity data is shown in FIG. 6B.
Figure 6B:
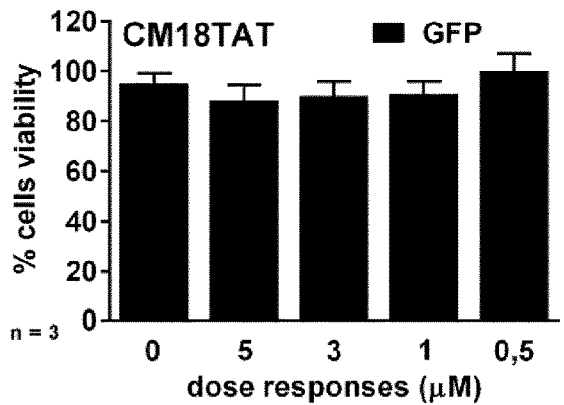

Dose response (CM18-TAT) and cell viability, data from FIGS. 6A and 6B

| | | | FIG. 6A | | FIG. 6B Cell viability |
|---|---|---|---|---|---|
| Shuttle | Cells | Concentration (µM) | Mean (%) (n = 3) | Standard deviation | (%) (±St. Dev.; n = 3) |
| CM18-TAT-Cys | HeLa | 0 | 0.69 | 0.12 | 95 ± 4 |
| | HeLa | 0.5 | 8.67 | 0.96 | 88.4 ± 6 |
| | HeLa | 1 | 20.03 | 2.55 | 90 ± 6 |
| | HeLa | 3 | 31.06 | 5.28 | 91 ± 5 |
| | HeLa | 5 | 36.91 | 4.33 | 90 ± 7 |

Table 3.1 and FIG. 6A show the results of flow cytometry analysis of the fluorescence intensity of HeLa cells transduced with GFP (5 µM) without or with 5, 3, 1, and 0.5 µM of CM18-TAT-Cys. Corresponding cellular toxicity data are presented in Table 3.1 and in FIG. 6B. These results suggest that the shuttle agent CM18-TAT-Cys increases the transduction efficiency of GFP in a dose-dependent manner.

TABLE 3.2

Figure 7A:
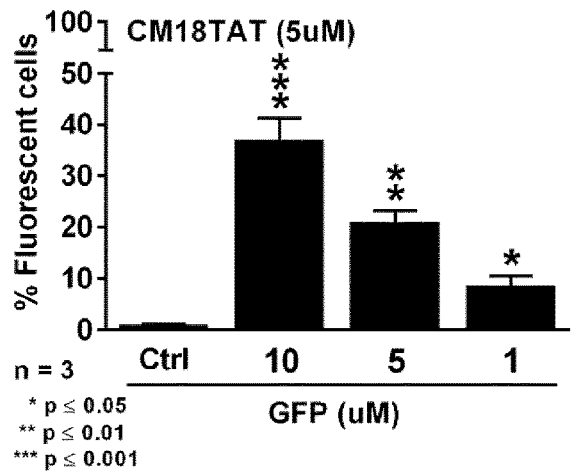
FIGS. 7A and 7B shows the results of a GFP transduction efficiency experiment in which different concentrations of GFP cargo protein (10, 5 or 1 µM) were co-incubated with either 5 µM of CM18-TAT-Cys (FIG. 7A, labeled "CM18TAT"), or 2.5 µM of dCM18-TAT-Cys (FIG. 7B, labeled "dCM18TAT"), prior to being exposed to HeLa cells. Cells were evaluated by flow cytometry and the percentages of fluorescent (GFP-positive) cells are shown.
Figure 7B:
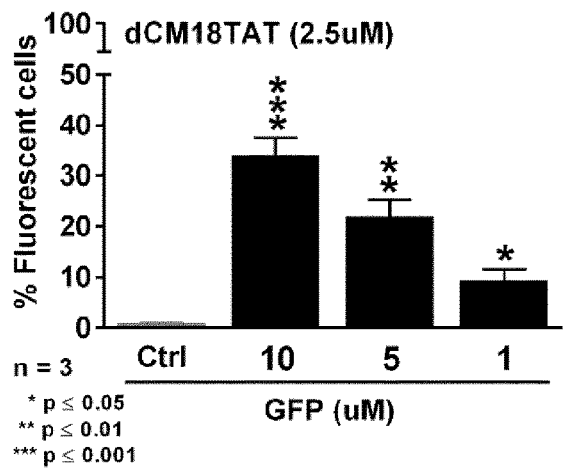

Dose response (GFP), data from FIGS. 7A and 7B

| Shuttle | Cells | Conc. of shuttle agent (µM) | Conc. of GFP (µM) | Mean (%) (n = 3) | Standard deviation |
|---|---|---|---|---|---|
| Control | HeLa | 0 | 10 | 0.93 | 0.08 |
| CM18-TAT-Cys | HeLa | 5 | 10 | 37.1 | 4.29 |
| | HeLa | 5 | 5 | 21.1 | 2.19 |
| | HeLa | 5 | 1 | 8.56 | 1.91 |
| Control | HeLa | 0 | 10 | 0.91 | 0.09 |
| dCM18-TAT-Cys | HeLa | 2.5 | 10 | 34.2 | 3.42 |
| | HeLa | 2.5 | 5 | 22.2 | 3.17 |
| | HeLa | 2.5 | 1 | 9.38 | 2.11 |

Table 3.2 and FIG. 7 show the results of flow cytometry analysis of the fluorescence intensity of HeLa cells transduced with different concentrations of GFP (1 to 10 µM) without or with 5 µM of CM18-TAT-Cys (FIG. 7A) or 2.5 µM dCMd8-TAT-Cys (FIG. 7B).

3.7 GFP Transduction in HeLa Cells: Dose Responses of CM8-TAT-Cys and CM18-Penetratin-Cys, and Dimers Thereof HeLa cells were cultured and tested in the protein transduction assay described in Example 3.1. Briefly, GFP recombinant protein (5 µM) was co-incubated with different concentrations and combinations of CM18-TAT-Cys, CM18-Penetratin-Cys, and dimers of each (dCM18-TAT-Cys, dCM18-Penetratin-Cys), and then exposed to HeLa cells for 1 hour. The cells were subjected to flow cytometry analysis as described in Example 3.3. The results are shown in Table 3.3 and FIG. 8, as well as in Table 3.4 and FIG. 9.

TABLE 3.3

Figure 8:
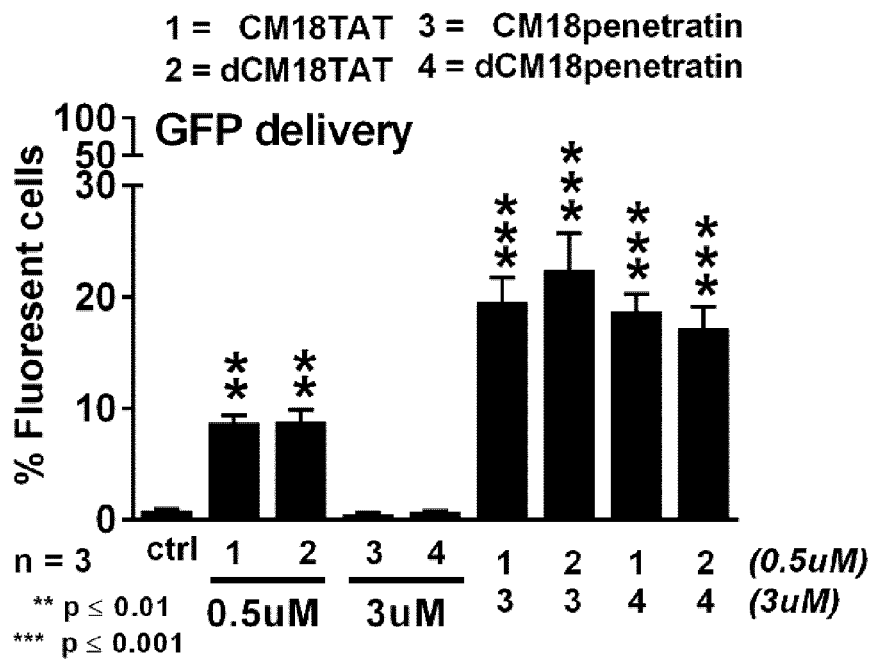
FIGS. 8 and 9 show the results of GFP transduction efficiency experiments in which GFP cargo protein (10 µM) was co-incubated with different concentrations and combinations of CM18-TAT-Cys (labeled "CM18TAT"), CM18-Penetratin-Cys (labeled "CM18penetratin"), and dimers of each (dCM18-TAT-Cys (labeled "dCM18TAT"), dCM18-Penetratin-Cys (labeled "dCM18penetratin"), prior to being exposed to HeLa cells. Cells were evaluated by flow cytometry and the percentages of fluorescent (GFP-positive) cells are shown.

Data in FIG. 8

| No. in FIG. 8 | Shuttle agent | Cells | Concentration (µM) | Mean (%) (n = 3) | Standard deviation |
|---|---|---|---|---|---|
| Control ("ctrl") | No shuttle | HeLa | 0 | 0.43 | 0.08 |
| 1 | CM18-TAT-Cys | HeLa | 0.5 | 8.75 | 0.63 |
| 2 | dCM18-TAT-Cys | HeLa | 0.5 | 8.86 | 1.03 |
| 3 | CM18-Penetratin-Cys | HeLa | 3 | 0.59 | 0.11 |
| 4 | dCM18-Penetratin-Cys | HeLa | 3 | 0.73 | 0.08 |
| 1 + 3 | CM18-TAT-Cys + CM18Penetratin-Cys | HeLa | 0.5 3 | 19.52 | 2.18 |
| 2 + 3 | dCM18-TAT-Cys + CM18-Penetratin-Cys | HeLa | 0.5 3 | 22.44 | 3.29 |
| 1 + 4 | CM18-TAT-Cys + dCM18-Penetratin-Cys | HeLa | 0.5 3 | 18.73 | 1.55 |
| 2 + 4 | dCM18-TAT-Cys + dCM18-Penetratin-Cys | HeLa | 0.5 3 | 17.19 | 1.93 |

The results in Table 3.3 and FIG. 8 show that the transduction efficiency of GFP is increased in HeLa cells using the shuttle agents CM18-TAT-Cys and dCM18-TAT-Cys (see bars "1" and "2" in FIG. 8). Although no GFP intracellular delivery was observed using CM18-Penetratin-Cys or dCM18-Penetratin-Cys alone (see bars "3" or "4" in FIG. 8), combination of CM18-TAT-Cys with CM18-Penetratin-Cys (monomer or dimer) improved GFP protein delivery (see four right-most bars in FIG. 8).

TABLE 3.4

Figure 9:
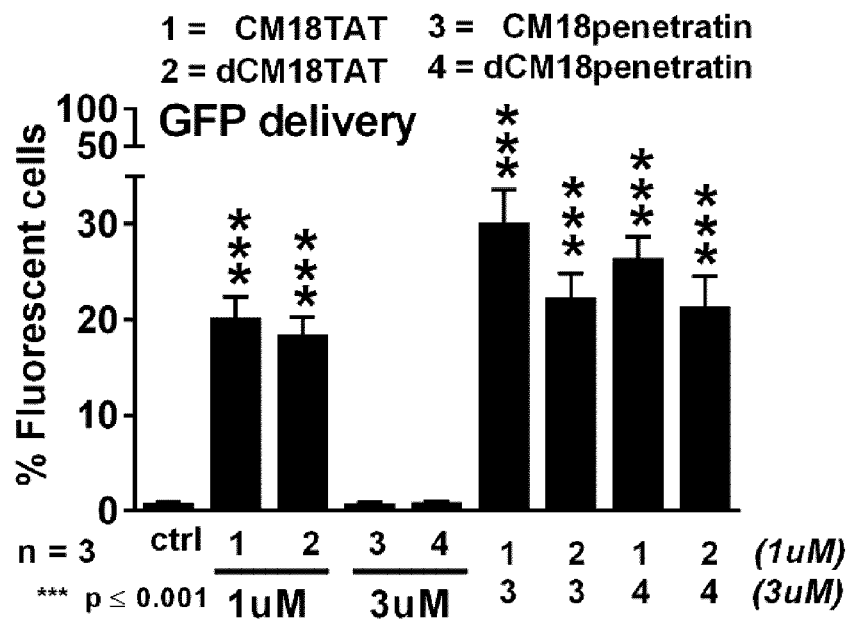

Data in FIG. 9

| No. in FIG. 9 | Shuttle | Cells | Concentration (µM) | Mean (%) (n = 3) | Standard deviation |
|---|---|---|---|---|---|
| Control ("ctrl") | No shuttle | HeLa | 0 | 0.51 | 0.07 |
| 1 | CM18-TAT-Cys | HeLa | 1 | 20.19 | 2.19 |
| 2 | dCM18-TAT-Cys | HeLa | 1 | 18.43 | 1.89 |
| 3 | CM18-Penetratin-Cys | HeLa | 3 | 0.81 | 0.07 |
| 4 | dCM18-Penetratin-Cys | HeLa | 3 | 0.92 | 0.08 |
| 1 + 3 | CM18-TAT-Cys + CM18-Penetratin-Cys | HeLa | 1 3 | 30.19 | 3.44 |
| 2 + 3 | dCM18-TAT-Cys + CM18-Penetratin-Cys | HeLa | 1 3 | 22.36 | 2.46 |
| 1 + 4 | CM18-TAT-Cys + dCM18-Penetratin-Cys | HeLa | 1 3 | 26.47 | 2.25 |
| 2 + 4 | dCM18-TAT-Cys + dCM18-Penetratin-Cys | HeLa | 1 3 | 21.44 | 3.11 |

The results in Table 3.4 and FIG. 9 show that the transduction efficiency of GFP is increased in HeLa cells using the shuttle agents CM18-TAT-Cys and dCM18-TAT-Cys (see bars "1" and "2" in FIG. 9). Although no GFP intracellular delivery was observed using CM18-Penetratin-Cys or dCM18-Penetratin-Cys alone (see bars "3" or "4" in FIG. 9), combination of CM18-TAT-Cys with CM18-Penetratin-Cys (monomer or dimer) improved GFP protein delivery (see four right-most bars in FIG. 9).

3.8 GFP Transduction by Shuttle Agents in HeLa Cells: Controls

HeLa cells were cultured and tested in the protein transduction assay described in Example 3.1. Briefly, GFP recombinant protein (5 µM) was co-incubated with 5 µM of each of the following peptide(s): TAT-Cys; CM18; Penetratin-Cys; TAT-Cys+CM18; Penetratin-Cys+CM18; and CM18-TAT-Cys, and then exposed to HeLa cells for 1 hour. GFP fluorescence was visualized by bright field and fluorescence microscopy. The microscopy results (data not shown) showed that GFP was successfully delivered intracellularly using CM18-TAT-Cys. However, GFP was not successfully delivered intracellularly using single-domain peptides used alone (CM18, TAT-Cys, Penetratin-Cys) or together (CM18+TAT-Cys, CM18+Penetratin-Cys). These results are consistent with those presented in Tables 2.1 and 2.2 with respect to the calcein endosome escape assays.

Example 4

Peptide Shuttle Agents Increase TAT-GFP Transduction Efficiency

The experiments in Example 3 showed the ability of shuttle agents to deliver GFP intracellularly. The experiments presented in this example show that the shuttle agents can also increase the intracellular delivery of a GFP cargo protein that is fused to a CPD (TAT-GFP).

4.1 Construction and Amino Acid Sequence of TAT-GFP

Construction was performed as described in Example 3.4, except that a TAT sequence was cloned between the 6× histidine tag and the GFP sequences. The 6× histidine tag, TAT, GFP and a stop codon (−) are separated by serine/glycine rich linkers. The recombinant TAT-GFP protein was purified as described in Example 1.4. The sequence of the TAT-GFP construct was:

SEQ ID NO: 61]
MHHHHHHGGGGSGGGGSGGASTGTGRKKRRQRRRPPQGGGGSGGGGSGGGT

GIRMVSKGEELFTGVVPILVELDGDVNGHKFSVSGEGEGDATYGKLTLKFI

CTTGKLPVPWPTLVTTLTYGVQCFSRYPDHMKQHDFFKSAMPEGYVQERTI

FFKDDGNYKTRAEVKFEGDTLVNRIELKGIDFKEDGNILGHKLEYNYNSHN

VYIMADKQNGIKVNFKIRHNIEDGSVQLADHYQQNTPIGDGPVLLPDNHYL

STQSALSKDPNEKRDHMVLLEFVTAAGITLGMDELYKGGSGGGSGGGSGWI

Figure 10:
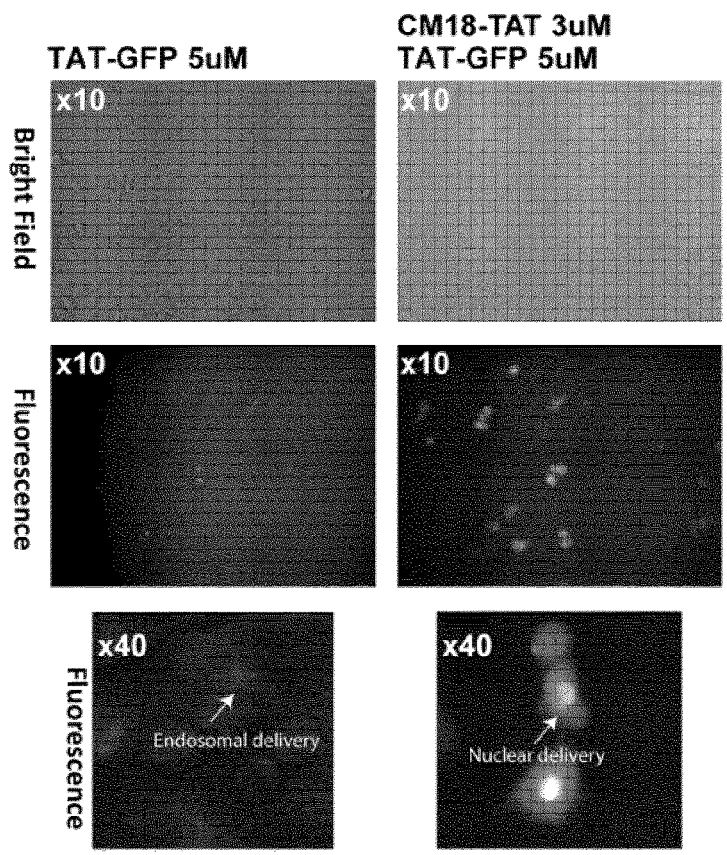
FIG. 10 shows typical results of a TAT-GFP transduction experiment in which TAT-GFP cargo protein (5 µM) was co-incubated with 3 µM of CM18-TAT-Cys (labeled "CM18-TAT"), prior to being exposed to HeLa cells. Cells and GFP fluorescence were visualized by bright field and fluorescence microscopy at 10× and 40× magnifications. Arrows indicate the endosome delivery of TAT-GFP in the absence of CM18-TAT-Cys, as well as its nuclear delivery in the presence of CM18-TAT-Cys.

RASSGGREIS-
(MW = 34.06 kDa; pI = 8.36)
TAT sequence is underlined
Serine/glycine rich linkers are in bold 4.2 TAT-GFP Transduction by CM18-TAT-Cys in HeLa Cells: Visualisation by Fluorescence Microscopy HeLa cells were cultured and tested in the protein transduction assay described in Example 3.1. Briefly, TAT-GFP recombinant protein (5 µM) was co-incubated with 3 µM of CM18-TAT-Cys and then exposed to HeLa cells for 1 hour. Cells and GFP fluorescence were visualized by bright field and fluorescence microscopy (as described in Example 3.2) at 10× and 40× magnifications, and sample results are shown in FIG. 10. The microscopy results revealed that in the absence of CM18-TAT-Cys, TAT-GFP shows a low intensity, endosomal distribution as reported in the literature. In contrast, TAT-GFP is delivered to the cytoplasm and to the nucleus in the presence of the shuttle agent CM18-TAT-Cys. Without being bound by theory, the TAT peptide itself may act as a nuclear localization signal (NLS), explaining the nuclear localization of TAT-GFP. These results show that CM18-TAT-Cys is able to increase TAT-GFP transduction efficiency and allow endosomally-trapped TAT-GFP to gain access to the cytoplasmic and nuclear compartments.

4.3 TAT-GFP Transduction by CM18-TAT-Cys in HeLa Cells: Dose Responses and Viability of Cells Transduced HeLa cells were cultured and tested in the protein transduction assay described in Example 3.1. Briefly, TAT-GFP recombinant protein (5 μM) was co-incubated with different concentrations of CM18-TAT-Cys (0, 0.5, 1, 3, or 5 μM) and then exposed to HeLa cells for 1 hour. The cells were subjected to flow cytometry analysis as described in Example 3.3. Results are shown in Table 4.3 and FIG. 11A. Corresponding cellular toxicity data are presented in FIG. 11B.

TABLE 4.3

Figure 11A:
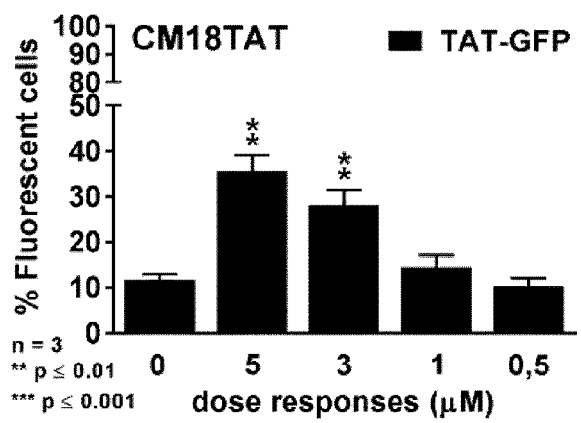
FIGS. 11A and 11B show the results of a TAT-GFP transduction efficiency experiment in which TAT-GFP cargo protein (5 µM) was co-incubated with different concentrations of CM18-TAT-Cys (labeled "CM18TAT"), prior to being exposed to HeLa cells. Cells were evaluated by flow cytometry and the percentage of fluorescent (GFP-positive) cell is shown in FIG. 11A, and corresponding cell toxicity data is shown in FIG. 11B.
Figure 11B:
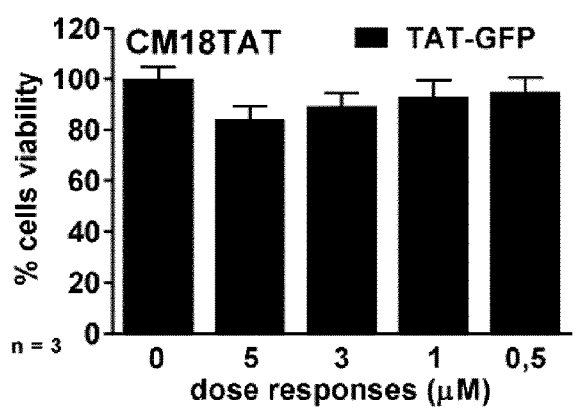

Data from FIGS. 11A and 11B

| Shuttle agent | Cells | Concentration (μM) | FIG. 11A Mean (%) (n = 3) | Standard deviation | FIG. 11B Cell viability (%) (±St. Dev.; n = 3) |
|---|---|---|---|---|---|
| CM18-TAT-Cys | HeLa | 0 | 11.79[1] | 1.16 | 100 |
| | HeLa | 0.5 | 10.19 | 1.94 | 84.36 ± 5 |
| | HeLa | 1 | 14.46 | 2.59 | 89.26 ± 5.26 |
| | HeLa | 3 | 28.12 | 3.27 | 93.18 ± 6.28 |
| | HeLa | 5 | 35.5[2] | 3.59 | 95.14 ± 5.28 |

[1] The fluorescence was mostly endosomal, as confirmed by fluorescence microscopy.
[2] Fluorescence was more diffuse and also nuclear, as confirmed by fluorescence microscopy.

Example 5

Peptide Shuttle Agents Increase GFP-NLS Transduction Efficiency and Nuclear Localization The experiments in Examples 3 and 4 showed the ability of shuttle agents to deliver GFP and TAT-GFP intracellularly. The experiments presented in this example show that the shuttle agents can facilitate nuclear delivery of a GFP protein cargo fused to a nuclear localization signal (NLS).

5.1 Construction and Amino Acid Sequence of GFP-NLS

Figure 12:
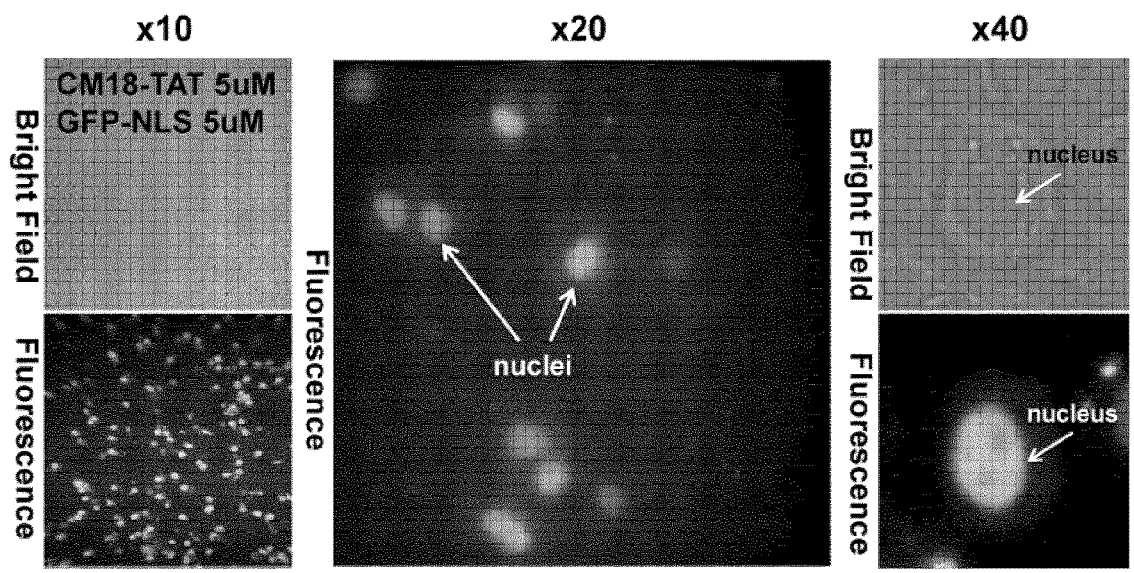
FIG. 12 shows typical results of a GFP-NLS transduction experiment in which GFP-NLS cargo protein (5 µM) was co-incubated with 5 µM of CM18-TAT-Cys (labeled "CM18-TAT"), prior to being exposed to HeLa cells for 5 minutes. Cells and GFP fluorescence were visualized by bright field and fluorescence microscopy at 10×, 20×, and 40× magnifications. Arrows indicate areas of nuclear delivery of GFP-NLS.

Construction was performed as described in Example 3.4, except that an optimized NLS sequence was cloned between the GFP sequence and the stop codon (-). The NLS sequence is separated from the GFP sequence and the stop codon by two serine/glycine rich linkers. The recombinant GFP-NLS protein was purified as described in Example 1.4. The sequence of the GFP-NLS construct was:

[SEQ ID NO: 62]
MHHHHHHGGGGSGGGGSGGGASTGIRMVSKGEELFTGVVPILVELDGDVNGH
KFSVSGEGEGDATYGKLTLKFICTTGKLPVPWPTLVTTLTYGVQCFSRYPD
HMKQHDFFKSAMPEGYVQERTIFFKDDGNYKTRAEVKFEGDTLVNRIELKG
IDFKEDGNILGHKLEYNYNSHNVYIMADKQKNGIKVNFKIRHNIEDGSVQL
ADHYQQNTPIGDGPVLLPDNHYLSTQSALSKDPNEKRDHMVLLEFVTAAGI
TLGMDELYKGGSGGGSGGGSGWIRASSGGRSSDDEATADSQHAAPPKKKRK
VGGSGGGSGGGSGGGRGTEIS-
(MW = 34.85 kDa; pI = 6.46)
NLS sequence is underlined
Serine/glycine rich linkers are in bold 5.2 Nuclear Delivery of GFP-NLS by CM18-TAT-Cys in HeLa Cells in 5 Minutes: Visualisation by Fluorescence Microscopy HeLa cells were cultured and tested in the protein transduction assay described in Example 3.1. Briefly, GFP-NLS recombinant protein (5 μM) was co-incubated with 5 μM of CM18-TAT-Cys, and then exposed to HeLa cells. GFP fluorescence was visualized by bright field and fluorescence microscopy after 5 minutes (as described in Example 3.2) at 10×, 20× and 40× magnifications, and sample results are shown in FIG. 12. The microscopy results revealed that GFP-NLS is efficiently delivered to the nucleus in the presence of the shuttle agent CM18-TAT-Cys, after only 5 minutes of incubation.

5.3 GFP-NLS Transduction by CM18-TAT-Cys in HeLa Cells: Dose Responses and Viability of Cells Transduced HeLa cells were cultured and tested in the protein transduction assay described in Example 3.1. GFP-NLS recombinant protein (5 μM) was co-incubated with 0, 0.5, 1, 3, or 5 μM of CM18-TAT-Cys, and then exposed to HeLa cells for 1 hour. The cells were subjected to flow cytometry analysis as described in Example 3.3. Results are shown in Table 5.1 and FIG. 13A. Corresponding cellular toxicity data are presented in FIG. 13B.

TABLE 5.1

Figure 13A:
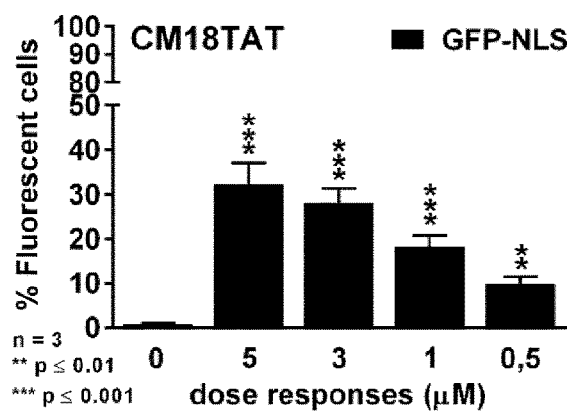
FIGS. 13A and 13B show the results of a GFP-NLS transduction efficiency experiment in which GFP-NLS cargo protein (5 µM) was co-incubated with different concentrations of CM18-TAT-Cys (labeled "CM18TAT"), prior to being exposed to HeLa cells. Cells were evaluated by flow cytometry and the percentage of fluorescent (GFP-positive) cell is shown in FIG. 13A, and corresponding cell toxicity data is shown in FIG. 13B.
Figure 13B:
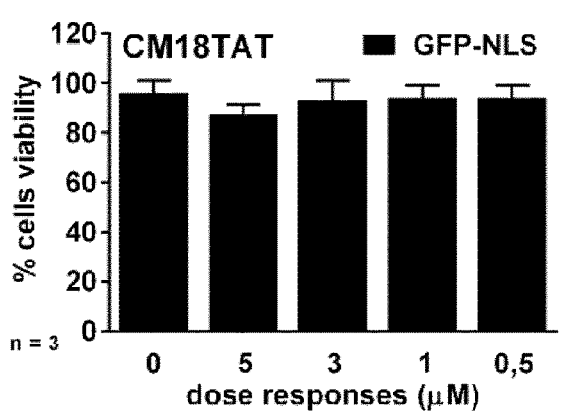

Data from FIGS. 13A and 13B

| Shuttle agent | Cells | Concentration (μM) | FIG. 13A Mean (%) (n = 3) | Standard deviation | FIG. 13B Cell viability (%) (±St Dev.; n = 3) |
|---|---|---|---|---|---|
| CM18-TAT-Cys | HeLa | 0 | 0.90 | 0.12 | 100 |
| | HeLa | 0.5 | 9.81 | 1.63 | 87.6 ± 4 |
| | HeLa | 1 | 18.42 | 2.47 | 93 ± 8 |
| | HeLa | 3 | 28.09 | 3.24 | 94 ± 5 |
| | HeLa | 5 | 32.26 | 4.79 | 93 ± 4 |

These results show that CM18-TAT-Cys is able to increase GFP-NLS transduction efficiency in HeLa cells in a dose-dependent manner.

5.4 GFP-NLS Transduction by CM18-TAT-Cys, CM18-Penetratin-Cys, and Dimers Thereof in HeLa Cells HeLa cells were cultured and tested in the protein transduction assay described in Example 3.1. GFP-NLS recombinant protein (5 μM) was co-incubated with different concentrations and combinations of CM18-TAT-Cys, CM18-Penetratin-Cys, and dimers of each (dCM18-TAT-Cys, dCM18-Penetratin-Cys), and then exposed to HeLa cells for 1 hour. The cells were subjected to flow cytometry analysis as described in Example 3.3. The results are shown in Tables 5.2 and 5.3, and in FIGS. 14 and 15.

TABLE 5.2

Figure 14:
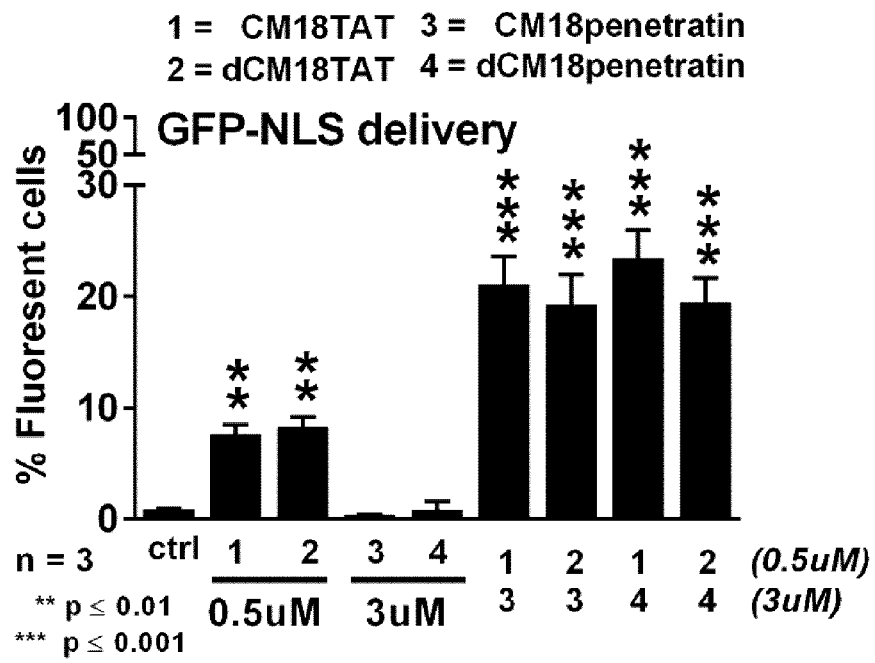
FIGS. 14 and 15 show the results of GFP-NLS transduction efficiency experiments in which GFP-NLS cargo protein (5 µM) was co-incubated with different concentrations and combinations of CM18-TAT (labeled "CM18TAT"), CM18-Penetratin (labeled "CM18penetratin"), and dimers of each (dCM18-TAT-Cys, dCM18-Penetratin-Cys; labeled "dCM18TAT" and "dCM18penetratin", respectively), prior to being exposed to HeLa cells. Cells were evaluated by flow cytometry and the percentages of fluorescent (GFP-positive) cells are shown.

Data in FIG. 14

| No. in FIG. 14 | Shuttle agent | Cells | Concentration (μM) | Mean (%) (n = 3) | Standard deviation |
|---|---|---|---|---|---|
| ctrl | No shuttle | HeLa | 0 | 0.41 | 0.10 |
| 1 | CM18-TAT-Cys | HeLa | 0.5 | 7.64 | 0.85 |
| 2 | dCM18-TAT-Cys | HeLa | 0.5 | 8.29 | 0.91 |
| 3 | CM18-Penetratin-Cys | HeLa | 3 | 0.43 | 0.08 |
| 4 | dCM18-Penetratin-Cys | HeLa | 3 | 0.85 | 0.07 |
| 1 + 3 | CM18-TAT-Cys + CM18-Penetratin-Cys | HeLa | 0.5 3 | 21.1 | 2.47 |

TABLE 5.2-continued

Data in FIG. 14

| No. in FIG. 14 | Shuttle agent | Cells | Concentration (µM) | Mean (%) (n = 3) | Standard deviation |
|---|---|---|---|---|---|
| 2 + 3 | dCM18-TAT-Cys + CM18-Penetratin-Cys | HeLa | 0.5 3 | 19.22 | 2.73 |
| 1 + 4 | CM18-TAT-Cys + dCM18-Penetratin-Cys | HeLa | 0.5 3 | 23.44 | 2.51 |
| 2 + 4 | dCM18-TAT-Cys + dCM18-Penetratin-Cys | HeLa | 0.5 3 | 19.47 | 2.16 |

TABLE 5.3

Figure 15:
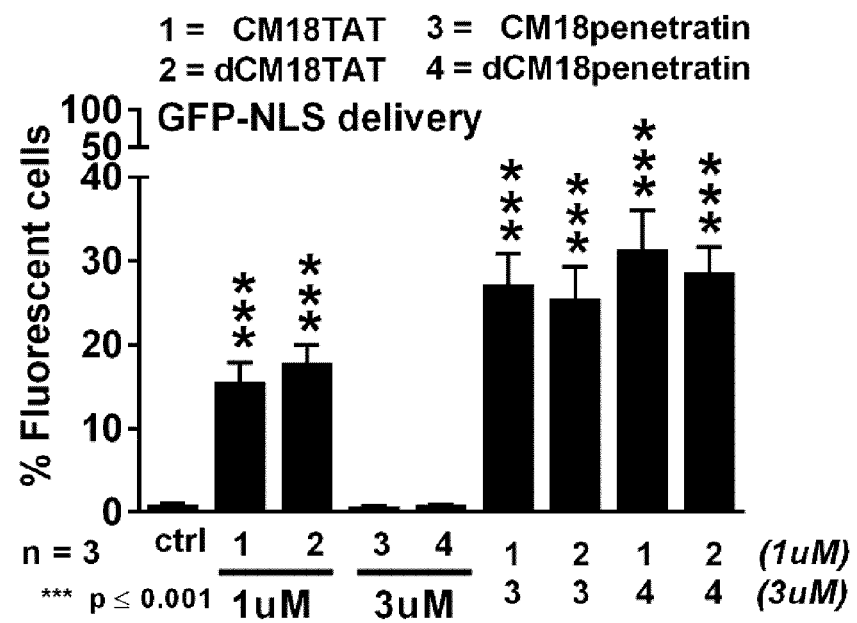

Data in FIG. 15

| No. in FIG. 15 | Shuttle agent | Cells | Concentration (µM) | Mean (%) (n = 3) | Standard deviation |
|---|---|---|---|---|---|
| ctrl | No shuttle | HeLa | 0 | 0.44 | 0.12 |
| 1 | CM18-TAT-Cys | HeLa | 1 | 15.56 | 2.24 |
| 2 | dCM18-TAT-Cys | HeLa | 1 | 17.83 | 2.13 |
| 3 | CM18-Penetratin-Cys | HeLa | 3 | 0.68 | 0.05 |
| 4 | dCM18-Penetratin-Cys | HeLa | 3 | 0.84 | 0.07 |
| 1 + 3 | CM18-TAT-Cys + CM18-Penetratin-Cys | HeLa | 1 3 | 27.26 | 3.61 |
| 2 + 3 | dCM18-TAT-Cys + CM18-Penetratin-Cys | HeLa | 1 3 | 25.47 | 3.77 |
| 1 + 4 | CM18-TAT-Cys + dCM18-Penetratin-Cys | HeLa | 1 3 | 31.47 | 4.59 |
| 2 + 4 | dCM18-TAT-Cys + dCM18-Penetratin-Cys | HeLa | 1 3 | 28.74 | 2.93 |

The results in Tables 5.2 and 5.3 and FIGS. 14 and 15 show that the transduction efficiency of GFP-NLS is increased in HeLa cells using the shuttle agents CM18-TAT-Cys and dCM18-TAT-Cys (see bars "1" and "2" in FIGS. 14 and 15). Although no GFP-NLS intracellular delivery was observed using CM18-Penetratin-Cys or dCM18-Penetratin-Cys alone (see bars "3" and "4" in FIGS. 14 and 15), combination of CM18-TAT-Cys with CM18-Penetratin-Cys (monomer or dimer) improved GFP-NLS intracellular delivery (see four right-most bars in FIGS. 14 and 15).

5.5 GFP-NLS Transduction by Shuttle Agents in HeLa Cells: 5 min v. 1 h Incubation; with or without FBS HeLa cells were cultured and tested in the protein transduction assay described in Example 3.1. GFP-NLS recombinant protein (5 µM) was co-incubated with either CM18-TAT-Cys (3.5 µM) alone or with dCM18-Penetratin-Cys (1 µM). Cells were incubated for 5 minutes or 1 hour in plain DMEM media ("DMEM") or DMEM media containing 10% FBS ("FBS"), before being subjected to flow cytometry analysis as described in Example 3.3. The results are shown in Table 5.4, and in FIG. 16. Cells that were not treated with shuttle agent or GFP-NLS ("ctrl"), and cells that were treated with GFP-NLS without shuttle agent ("GFP-NLS 5 µM") were used as controls.

TABLE 5.4

Figure 16:
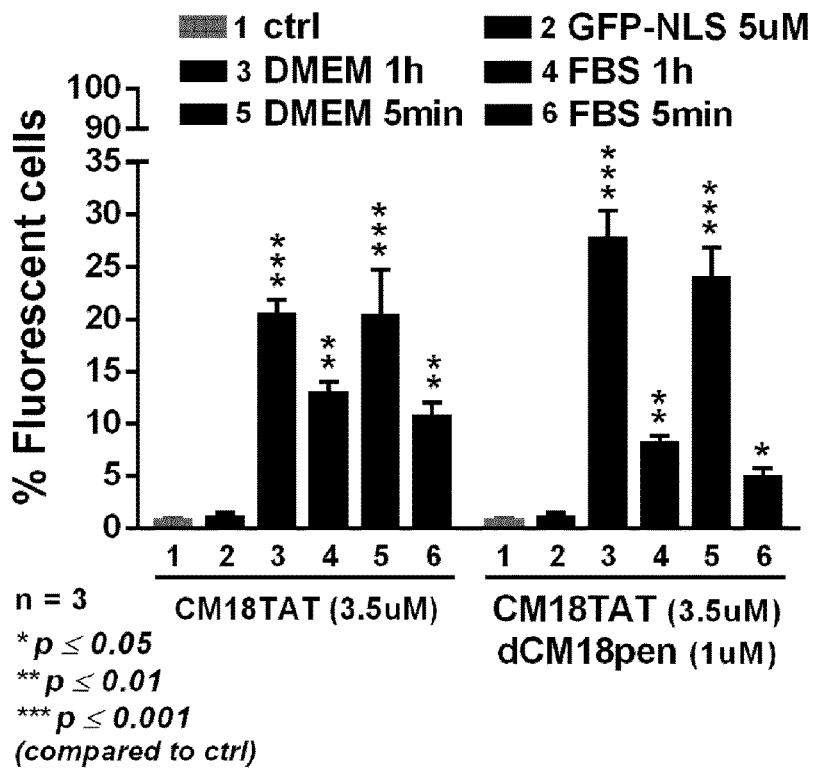
FIG. 16 shows the results of a GFP-NLS transduction efficiency experiment in which GFP-NLS cargo protein (5 µM) was co-incubated with either CM18-TAT-Cys (3.5 µM, labeled "CM18TAT") alone or with dCM18-Penetratin-Cys (1 µM, labeled "dCM18pen") for 5 minutes or 1 hour in plain DMEM media ("DMEM") or DMEM media containing 10% FBS ("FBS"), before being subjected to flow cytometry analysis. The percentages of fluorescent (GFP-positive) cells are shown. Cells that were not treated with shuttle agent or GFP-NLS ("ctrl"), and cells that were treated with GFP-NLS without shuttle agent ("GFP-NLS 5 µM") were used as controls.

Data in FIG. 16

| Shuttle | No. in FIG. 16 | Cells | Medium | Incubation time | Shuttle Conc. (µM) | Mean (%) (n = 3) | Standard deviation |
|---|---|---|---|---|---|---|---|
| No shuttle (Ctrl) | 1 | HeLa | DMEM | 1 h | 0 | 0.59 | 0.09 |
| GFP-NLS alone | 2 | HeLa | DMEM | 1 h | 0 | 1.19 | 0.31 |
| CM18-TAT-Cys | 3 | HeLa | DMEM | 1 h | 3.5 | 20.69 | 1.19 |
| | 4 | HeLa | FBS | 1 h | 3.5 | 13.20 | 0.82 |
| CM18-TAT-Cys | 5 | HeLa | DMEM | 5 min | 3.5 | 20.45 | 4.26 |
| | 6 | HeLa | FBS | 5 min | 3.5 | 10.83 | 1.25 |
| No shuttle (Ctrl) | 1 | HeLa | DMEM | 1 h | 0 | 0.53 | 0.11 |
| GFP-NLS alone | 2 | HeLa | DMEM | 1 h | 0 | 1.25 | 0.40 |
| CM18-TAT-Cys + dCM18-Penetratin-Cys | 3 | HeLa | DMEM | 1 h | 3.51 | 27.90 | 2.42 |
| | 4 | HeLa | FBS | 1 h | 3.51 | 8.35 | 0.46 |
| CM18-TAT-Cys + dCM18-Penetratin-Cys | 5 | HeLa | DMEM | 5 min | 3.51 | 24.10 | 2.76 |
| | 6 | HeLa | FBS | 5 min | 3.51 | 5.02 | 0.72 |

The results in Table 5.4 and FIG. 16 show that the addition of even a relatively low amount of the dimer dCM18-Penetratin-Cys (1 μM; "dCM18pen") to the CM18-TAT-Cys monomer improved GFP-NLS transduction efficiency. Interestingly, intracellular GFP-NLS delivery was achieved in as little as 5 minutes of incubation, and delivery was still achievable (although reduced) in the presence of FBS.

5.6 GFP-NLS Transduction by Shuttle Agents in THP-1 Suspension Cells

The ability of the shuttle agents to deliver GFP-NLS intracellularly was tested in THP-1 cells, which is an acute monocytic leukemia cell line that grows in suspension. THP-1 cells were cultured (see Example 1) and tested in the protein transduction assay described in Example 3.1. GFP-NLS recombinant protein (5 μM) was co-incubated with or without 1 μM CM18-TAT-Cys, and exposed to the THP-1 cells for 5 minutes, before being subjected to flow cytometry analysis as described in Example 3.3. The results are shown in Table 5.5 and in FIG. 17A. Corresponding cellular toxicity data are presented in FIG. 17B.

TABLE 5.5

Figure 17A:
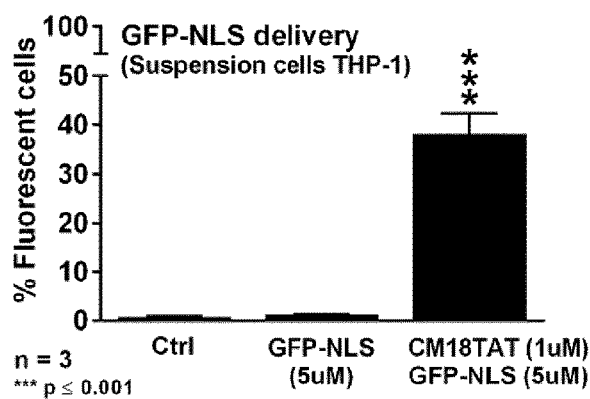
FIGS. 17A and 17B show the results of a GFP-NLS transduction efficiency experiment in which GFP-NLS cargo protein (5 µM) was co-incubated with or without 1 µM CM18-TAT-Cys (labeled "CM18TAT"), prior to being exposed to THP-1 cells. Cells were evaluated by flow cytometry and the percentage of fluorescent (GFP-positive) cells is shown in FIG. 17A, and corresponding cell toxicity data is shown in FIG. 17B.
Figure 17B:
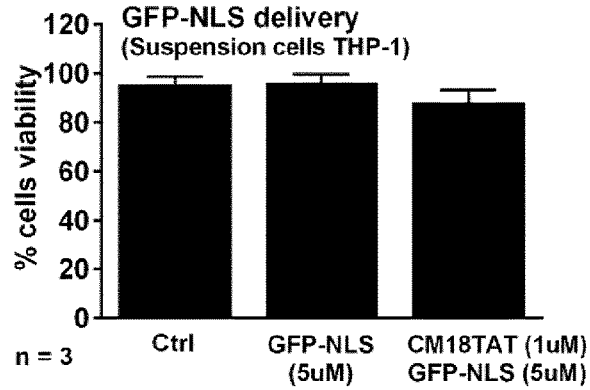

Data in FIGS. 17A and 17B

| Shuttle | Cells | Shuttle Conc. (μM) | FIG. 17A Mean (%) (n = 3) | Standard deviation | FIG. 17B Cell viability (%) (±St Dev.; n = 3) |
|---|---|---|---|---|---|
| No shuttle (Ctrl) | THP-1 | 0 | 1.23 | 0.16 | 95 ± 4 |
| GFP-NLS alone | | 0 | 2.49 | 0.37 | 96 ± 3 |
| CM18-TAT-Cys | | 1 | 38.1 | 4.16 | 85 ± 6 |

The results in Table 5.5 and FIG. 17 demonstrate the ability of the shuttle agents to deliver protein cargo intracellularly to a human monocytic cell line grown in suspension.

Example 6

Peptide Shuttle Agents Increase Transduction Efficiency of an FITC-Labeled Anti-Tubulin Antibody The experiments in Examples 3-5 showed the ability of shuttle agents to increase the transduction efficiency of GFP, TAT-GFP, and GFP-NLS. The experiments presented in this example show that the shuttle agents can also deliver a larger protein cargo: an FITC-labeled anti-tubulin antibody. The FITC-labeled anti-tubulin antibody was purchased from (Abcam, ab64503) and has an estimated molecular weight of 150 KDa. The delivery and microscopy protocols are described in Example 3.

Figure 18:
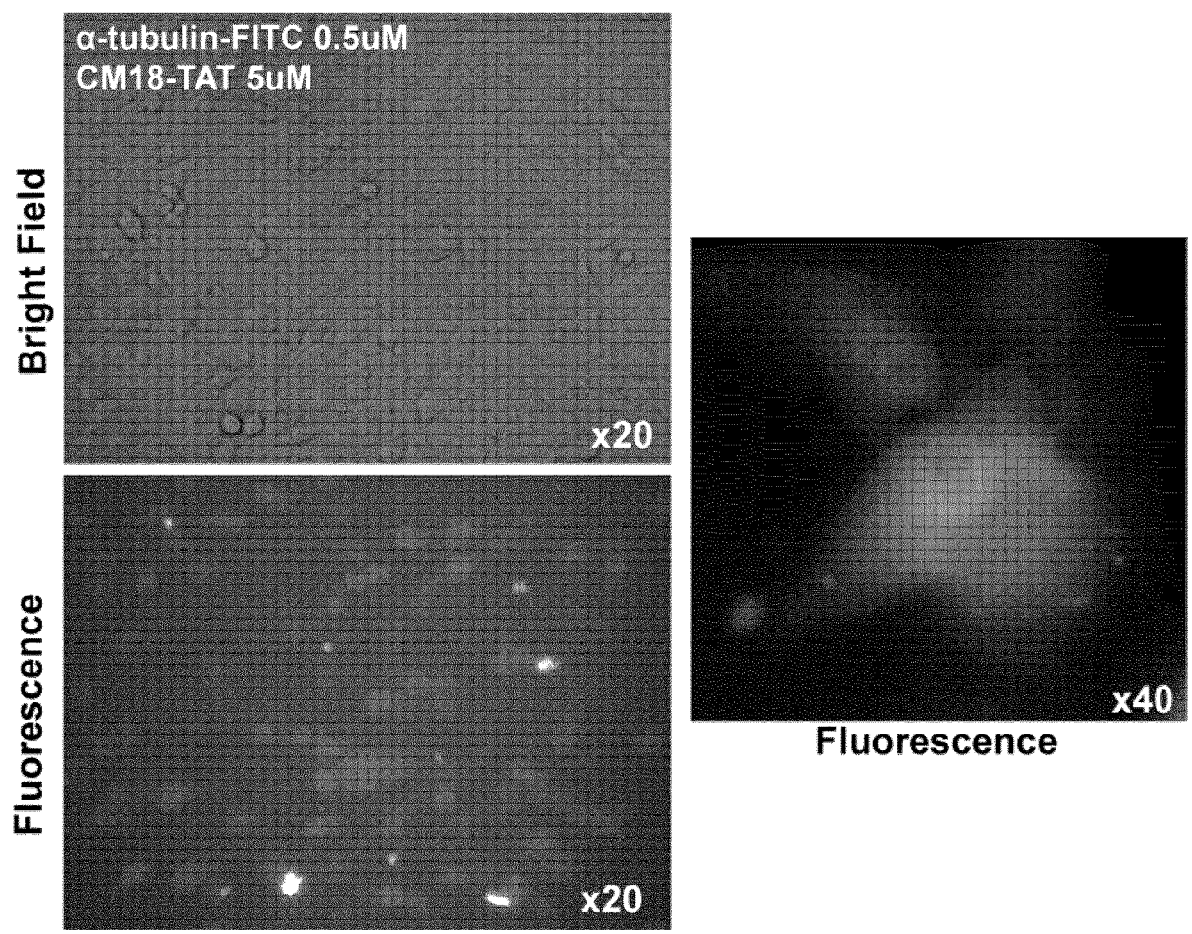
FIG. 18 shows the results of a transduction efficiency experiment in which the cargo protein, FITC-labeled anti-tubulin antibody (0.5 µM), was co-incubated with 5 µM of CM18-TAT-Cys (labeled "CM18-TAT"), prior to being exposed to HeLa cells. Functional antibody delivery was visualized by bright field (20×) and fluorescence microscopy (20× and 40×), in which fluorescent tubulin fibers in the cytoplasm were visualized.

6.1 Transduction of a Functional Antibody by CM18-TAT-Cys in HeLa Cells: Visualization by Microscopy FITC-labeled anti-tubulin antibody (0.5 μM) was co-incubated with 5 μM of CM18-TAT-Cys and exposed to HeLa cells for 1 hour. Antibody delivery was visualized by bright field (20×) and fluorescence microscopy (20× and 40×). As shown in FIG. 18, fluorescent tubulin fibers in the cytoplasm were visualized, demonstrating the functionality of the antibody inside the cell.

6.2 Transduction of a Functional Antibody by CM18-TAT-Cys, CM18-Penetratin-Cys, and Dimers in HeLa Cells: Flow Cytometry HeLa cells were cultured and tested in the protein transduction assay described in Example 3.1. FITC-labeled anti-tubulin antibody (0.5 μM) was co-incubated with 3.5 μM of CM18-TAT-Cys, CM18-Penetratin-Cys or dCM18-Penetratin-Cys, or a combination of 3.5 μM of CM18-TAT-Cys and 0.5 μM of dCM18-Penetratin-Cys, and exposed to HeLa cells for 1 hour. The cells were subjected to flow cytometry analysis as described in Example 3.3. Results are shown in Table 6.1 and FIG. 19A. Corresponding cellular toxicity data are presented in FIG. 19B.

TABLE 6.1

Figure 19A:
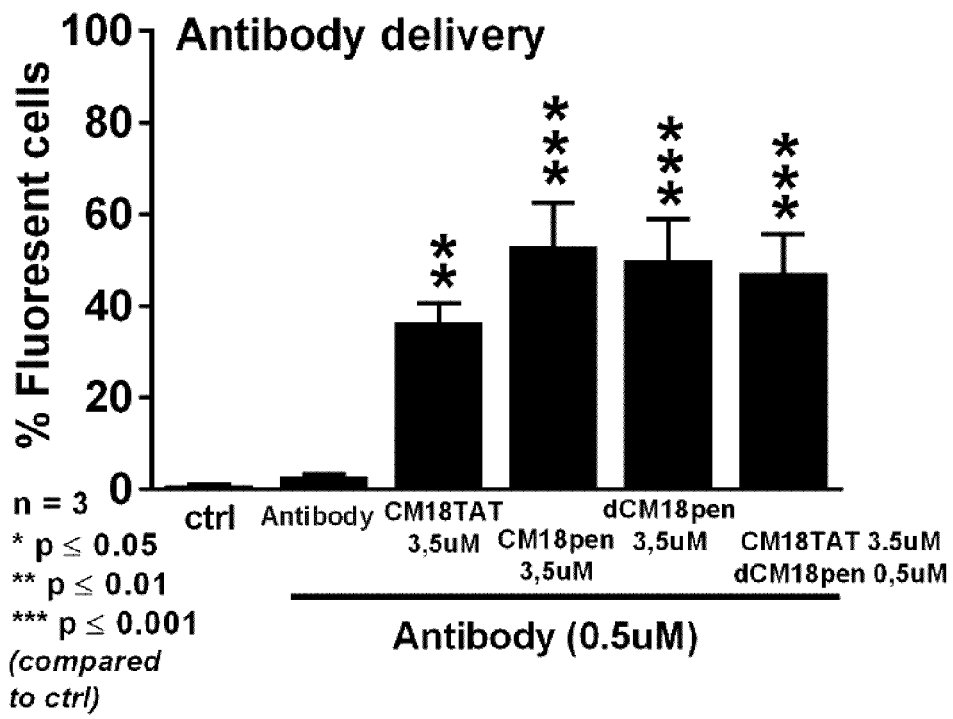
FIGS. 19A and 19B shows the results of an FITC-labeled anti-tubulin antibody transduction efficiency experiment in which the antibody cargo protein (0.5 µM) was co-incubated with 3.5 µM of CM18-TAT-Cys (labeled "CM18TAT"), CM18-Penetratin-Cys (labeled "CM18pen") or dCM18-Penetratin-Cys (labeled "dCM18pen"), or a combination of 3.5 µM of CM18-TAT-Cys and 0.5 µM of dCM18-Penetratin-Cys, prior to being exposed to HeLa cells. Cells were evaluated by flow cytometry and the percentage of fluorescent (FITC-positive) cell is shown in FIG. 19A, and corresponding cell toxicity data is shown in FIG. 19B.
Figure 19B:
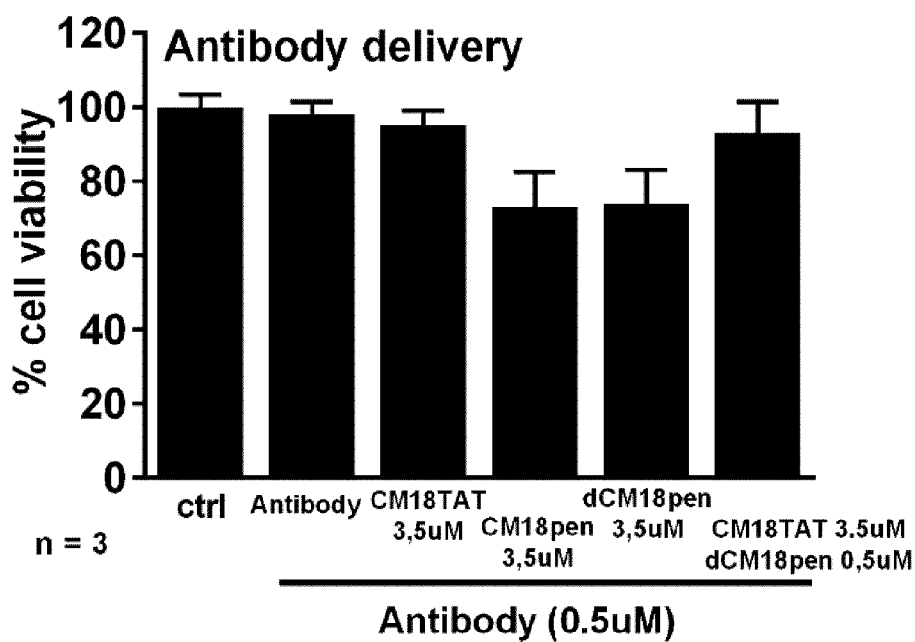

Data from FIG. 19A and 19B

| Domains | Shuttle agent | Cells | Shuttle Conc. (μM) | FIG. 19A Mean (%) (n = 3) | Standard deviation | FIG. 19B Cell viability (%) (± St. Dev.; n = 3) |
|---|---|---|---|---|---|---|
| — | No shuttle ("Ctrl") | HeLa | 0 | 0.9 | 0.06 | 98 ± 1.0 |
| — | Antibody alone ("antibody") | HeLa | 0 | 2.66 | 0.61 | 96 ± 3.4 |
| ELD-CPD | CM18-TAT-Cys | HeLa | 3.5 | 36.56 | 4.06 | 95 ± 4.06 |
| | CM18-Penetratin-Cys | HeLa | 3.5 | 53.05 | 9.5 | 73 ± 9.5 |
| ELD-CPD dimer | dCM18-Penetratin-Cys | HeLa | 3.5 | 50.23 | 9.12 | 74 ± 9.0 |
| ELD-CPD + ELD-CPD dimer | CM18-TAT-Cys + dCM18-Penetratin-Cys | HeLa | 3.5 0.5 | 47.19 | 8.5 | 93 ± 8.5 |

The results in Table 6.1 and FIGS. 18 and 19 show that both CM18-TAT-Cys and CM18-Penetratin-Cys facilitate intracellular delivery of an FITC-labeled anti-tubulin antibody. In contrast to the results with GFP, TAT-GFP, and GFP-NLS in Examples 3-5, CM18-Penetratin-Cys was able to deliver the antibody cargo intracellularly when used alone (without CM18-TAT-Cys). However, combination of CM18-TAT-Cys and dCM18-Penetratin-Cys allowed for higher intracellular delivery as compared with CM18-TAT-Cys alone, and with less cell toxicity as compared to CM18-Penetratin-Cys and dCM18-Penetratin-Cys (see FIGS. 19A and 19B).

Example 7

CM18-TAT-Cys Enables Intracellular Plasmid DNA Delivery but Poor Plasmid Expression The ability of the CM18-TAT-Cys shuttle agent to deliver plasmid DNA intracellularly was tested in this example on HEK293A cells using a plasmid encoding GFP.

7.1 Transfection Assay in HEK293A Cells

One day before the transfection assay was performed, mammalian cells (HEK293A) in exponential growth phase were harvested and plated in a 24-well plate (50,000 cells per well). The cells were incubated overnight in appropriate growth media containing FBS. The next day, in separate sterile 1.5 mL tubes, pEGFP labeled with a Cy5™ fluorochrome was mixed for 10 min at 37° C. with CM18-TAT-Cys (0.05, 0.5, or 5 μM) in fresh PBS at a final 100 μL volume. The media in wells was removed and the cells were quickly washed three times with PBS and 500 μL of warm media without FBS was added. The pEGFP and CM18-TAT-Cys solution was added to the cells and incubated at 37° C. for 4 hours. After the incubation, cells were washed with PBS and fresh media containing FBS was added. Cells were incubated at 37° C. before being subjected to flow cytometry analysis as described in Example 3.

7.2 Plasmid DNA Delivery with CM18-TAT-Cys

Plasmid DNA (pEGFP) was labeled with a Cy5™ dye following the manufacturer's instructions (Mirus Bio LLC). Cy5™ Moiety did not influence transfection efficiency when compared to unlabelled plasmid using standard transfection protocol (data not shown). Flow cytometry analysis allowed quantification of Cy5™ emission, corresponding to DNA intracellular delivery, and GFP emission, corresponding to successful nuclear delivery, DNA transcription and protein expression. The results are shown in Table 7.1 and in FIG. 20.

TABLE 7.1

Figure 20:
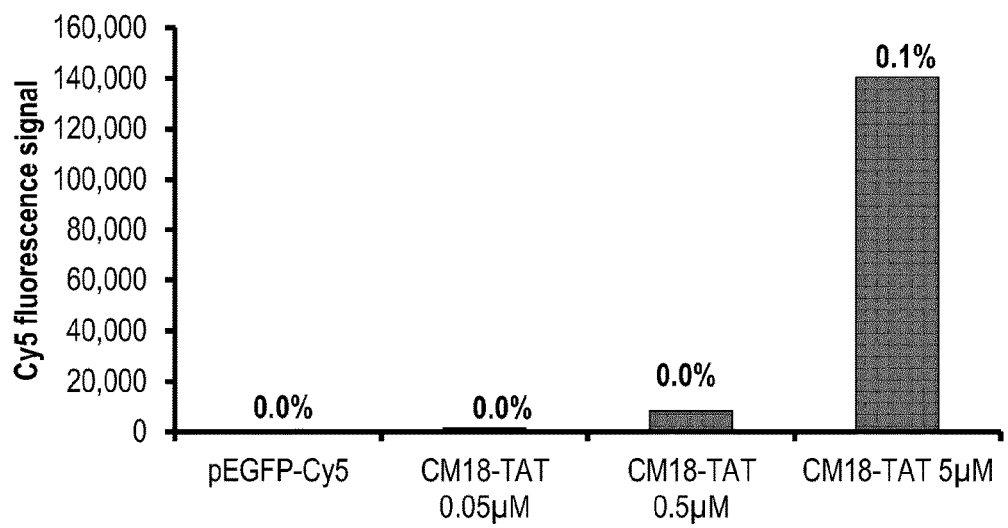
FIG. 20 shows the results of DNA transfection efficiency experiment in which plasmid DNA (pEGFP) was labeled with a Cy5™ dye was co-incubated with 0, 0.05, 0.5, or 5 µM of CM18-TAT-Cys (labeled "CM18-TAT"), prior to being exposed to HEK293A cells. Flow cytometry analysis allowed quantification of Cy5™ emission (corresponding to DNA intracellular delivery; y-axis) and GFP emission (corresponding to successful nuclear delivery of DNA; percentage indicated above each bar).

Data from FIG. 20

| Sample | DNA (ng) | Cy5™ fluorescence | | GFP expression | |
|---|---|---|---|---|---|
| | | Mean Cy5™ signal (n = 3) | Standard deviation | Mean (% of cells with GFP signal; n = 3) | Standard deviation |
| pEGFP-Cy5 alone | 500 | 914 | 0 | 0.0% | n/a |
| CM18-TAT-Cys, 0.05 μM | 500 | 1450 | 120 | 0.0% | n/a |
| CM18-TAT-Cys, 0.5 μM | 500 | 8362 | 294 | 0.0% | n/a |
| CM18-TAT-Cys, 5 μM | 500 | 140 497 | 3977 | 0.1% | n/a |

The results shown in Table 7.1 and in FIG. 20 show that CM18-TAT-Cys was able to increase the intracellular delivery the plasmid DNA when used at 0.05, 0.5 and 5 μM concentrations, as compared to cell incubated with DNA alone ("pEGFP-Cy5"). However, no expression of GFP was detected in the cells, which suggests that very little of the plasmid DNA gained access to the cytoplasmic compartment, allowing nuclear localization. Without being bound by theory, it is possible that the plasmid DNA was massively sequestered in endosomes, preventing escape to the cytoplasmic compartment. Salomone et al., 2013 reported the use of a CM18-TAT11 hybrid peptide to deliver plasmid DNA intracellularly. They used the luciferase enzyme reporter assay to assess transfection efficiency, which may not be ideal for quantifying the efficiency of cytoplasmic/nuclear delivery, as the proportion of plasmid DNA that is successfully released from endosomes and delivered to the nucleus may be overestimated due to the potent activity of the luciferase enzyme. In this regard, the authors of Salomone et al., 2013 even noted that the expression of luciferase occurs together with a massive entrapment of (naked) DNA molecules into vesicles, which is consistent with the results shown in Table 7.1 and in FIG. 20.

7.3 Plasmid DNA Delivery by Peptides in HeLa Cells

Following the poor transfection efficiency of the peptide CM18-TAT-Cys (0.1%, see Table 7.1) observed in HEK293A cells, the experiment was repeated with CM18-TAT-Cys in another cell line (HeLa), along with other peptides listed in Table 1.3, Table B1, and Table C1.

One day before the transfection assay was performed, HeLa cells in exponential growth phase were harvested and plated in a 96-well plate (10,000 cells per well). The cells were incubated overnight in appropriate growth media containing FBS. The next day, in separate sterile 1.5 mL tubes, the peptide to be tested and the polynucleotide cargo (pEGFP-C1) were mixed for 10 min at 37° C. in serum-free medium at a final volume of 50 μL. The media in wells was removed and the cells were quickly washed one time with PBS at 37° C. The mix containing the peptide to be tested and the polynucleotide cargo was added to the cells and incubated at 37° C. for the indicated period of time (e.g., 1 min, 1 h or 4 h). After the incubation, cells were washed one time with PBS at 37° C. and fresh media containing FBS was added. Cells were incubated at 37° C. before being subjected to flow cytometry analysis as described in Example 3.2, to qualify transfection efficiency (i.e., cells expression EGFP) and viability. Results are shown in Table 7.2.

TABLE 7.2

DNA transfection in HeLa cells using peptides

| Peptide | Mean % cells with GFP signal (±St. Dev.; n = 3) | Cell viability (%) (±St. Dev.; n = 3) |
|---|---|---|
| No peptide (neg. control) | 0.0 ± 0.0 | 100 |
| PTD4-KALA | 0.85 ± 0.04 | 53.64 ± 3.91 |
| FSD9 | 0.81 ± 0.09 | 36.1 ± 3.41 |
| KALA | 0.79 ± 0.06 | 90.62 ± 4.16 |
| His-CM18-Transportan | 0.55 ± 0.01 | 11.89 ± 1.07 |
| FSD12 | 0.37 ± 0.14 | 58.6 ± 2.07 |
| dCM18-Pen-Cys | 0.35 ± 0.02 | 3.36 ± 0.26 |
| His-CM18-PTD4-His | 0.34 ± 0.03 | 29.4 ± 2.38 |
| FSD2 | 0.34 ± 0.00 | 55.77 ± 4.19 |
| Pep1-KALA | 0.31 ± 0.03 | 92.47 ± 3.42 |
| F5D25 | 0.31 ± 0.02 | 98.19 ± 1.19 |
| FSD7 | 0.29 ± 0.07 | 60.9 ± 7.59 |
| CM18-PTD4-His | 0.26 ± 0.01 | 29.5 ± 0.21 |
| FSD19 | 0.24 ± 0.01 | 97.41 ± 2.07 |
| FSD10 | 0.21 ± 0.01 | 72.36 ± 8.61 |
| FSD24 | 0.20 ± 0.00 | 96.45 ± 3.02 |
| FSD15 | 0.18 ± 0.02 | 98.3 ± 1.07 |
| 12His-CM18-PTD4 | 0.18 ± 0.01 | 97.55 ± 1.57 |
| CM18-L1-PTD4 | 0.16 ± 0.01 | 84.3 ± 5.64 |
| FSD33 | 0.15 ± 0.01 | 75.3 ± 4.19 |
| TAT-LAH4 | 0.15 ± 0.00 | 96.17 ± 2.70 |
| CM18-L2-PTD4 | 0.14 ± 0.01 | 93.7 ± 3.07 |
| M-His-CM18-TAT-Cys | 0.13 ± 0.01 | 33.1 ± 0.4 |
| FSD42 | 0.12 ± 0.02 | 96.67 ± 1.96 |
| FSD11 | 0.11 ± 0.01 | 46.2 ± 1.35 |
| Xentry-KALA | 0.1 ± 0.02 | 75.3 ± 4.29 |
| FSD5 | 0.1 ± 0.01 | 93.24 ± 8.63 |
| 3HA-CM18-PTD4 | 0.09 ± 0.01 | 51.48 ± 4.83 |
| FSD32 | 0.08 ± 0.02 | 98.36 ± 0.15 |
| CM18-TAT-Cys | 0.08 ± 0.01 | 96.28 ± 1.86 |
| FSD8 | 0.06 ± 0.84 | 42.3 ± 6.42 |
| CM18-L3-PTD4 | 0.06 ± 0.01 | 98.4 ± 0.83 |
| 3His-CM18-PTD4 | 0.06 ± 0.01 | 82.05 ± 6.81 |
| CM18-PTD4 | 0.06 ± 0.01 | 49.64 ± 5.06 |
| TAT-CM18 | 0.06 ± 0.01 | 44.79 ± 4.17 |
| HA-CM18-PTD4 | 0.06 ± 0.0 | 53.21 ± 4.62 |
| His-CM18-TAT | 0.05 ± 0.01 | 13.6 ± 0.18 |
| VSVG-PTD4 | 0.05 ± 0.01 | 96.21 ± 2.57 |
| 9His-CM18-PTD4 | 0.04 ± 0.01 | 98.72 ± 0.93 |
| JST-PTD4 | 0.04 ± 0.01 | 70.2 ± 5.39 |
| His-CM18-PTD4 | 0.04 ± 0.01 | 63.2 ± 4.07 |
| FSD23 | 0.04 ± 0.00 | 98.18 ± 1.03 |
| FSD20 | 0.04 ± 0.00 | 20.49 ± 3.53 |
| FSD38 | 0.02 ± 0.00 | 95 ± 2.78 |
| FSD16 | 0.02 ± 0.00 | 99.07 ± 0.73 |
| FSD26 | 0.02 ± 0.00 | 97.2 ± 1.53 |
| FSD27 | 0.02 ± 0.00 | 98 ± 0.63 |
| FSD35 | 0.02 ± 0.00 | 96.14 ± 1.67 |
| CM18 | 0.02 ± 0.00 | 99.4 ± 0.14 |
| FSD30 | 0.02 ± 0.00 | 97.41 ± 2.06 |
| His-CM18-9Arg | 0.02 ± 00.0 | 31.63 ± 0.11 |
| FSD21 | 0.01 ± 0.00 | 96.17 ± 1.69 |
| 6His-PTD4 | 0.01 ± 0.00 | 97.25 ± 1.34 |
| FSD31 | 0.01 ± 0.00 | 98.43 ± 0.43 |
| FSD34 | 0.01 ± 0.00 | 96.43 ± 2.41 |
| FSD36 | 0.01 ± 0.00 | 97.05 ± 1.99 |
| FSD40 | 0.01 ± 0.00 | 98.63 ± 1.08 |
| FSD41 | 0.01 ± 0.00 | 94.38 ± 2.81 |
| FSD28 | 0.01 ± 0.00 | 97 ± 1.11 |
| CM18-Pen-Cys | 0.01 ± 0.0 | 16.1 ± 0.12 |
| PTD4 | 0.00 ± 0.01 | 98.2 ± 0.69 |
| FSD39 | 0.00 ± 0.00 | 99.2 ± 0.61 |
| His-CMH18-PTD4 | 0.00 ± 0.00 | 95.15 ± 2.33 |
| Penetratin | 0.00 ± 0.00 | 97.42 ± 1.03 |
| C(LLKK)3 | 0.00 ± 0.00 | 81.74 ± 2.34 |

All the peptides tested in Table 7.2 showed transfection efficiencies lower than 1%. Furthermore, the low transfection efficiency of CM18-TAT-Cys was confirmed in HeLa cells (0.08%). These results show that peptides which are suitable for delivering polypeptide cargos may not necessarily be suitable for delivering plasmid DNA. For example, the shuttle agent His-CM18-PTD4-His is shown herein to effectively transduce polypeptide cargos (e.g., see Example 10), yet this peptide displayed only a DNA plasmid transfection efficiency of 0.34% (Table 7.2).

Example 8

Addition of a Histidine-Rich Domain to Shuttle Agents Further Improves GFP-NLS Transduction Efficiency 8.1 GFP-NLS Transduction by His-CM18-TAT-Cys in HeLa Cells: Visualization by Microscopy GFP-NLS (5 µM; see Example 5) was co-incubated with 5 µM of CM18-TAT-Cys or His-CM18-TAT and exposed to HeLa cells for 1 hour. Nuclear fluorescence of intracellularly delivered GFP-NLS was confirmed by fluorescence microscopy (data not shown), indicating successful delivery of GFP-NLS to the nucleus.

8.2 GFP-NLS Transduction by His-CM18-TAT in HeLa Cells: Flow Cytometry

HeLa cells were cultured and tested in the protein transduction assay described in Example 3.1. GFP-NLS (5 µM) was co-incubated with 0, 1, 3, or 5 µM of CM18-TAT-Cys or His-CM18-TAT, and exposed to HeLa cells for 1 hour. The cells were subjected to flow cytometry analysis as described in Example 3.3. Results are shown in Table 8.1 and FIG. 21A. Corresponding cellular toxicity data are presented in FIG. 21B.

TABLE 8.1

Figure 21A:
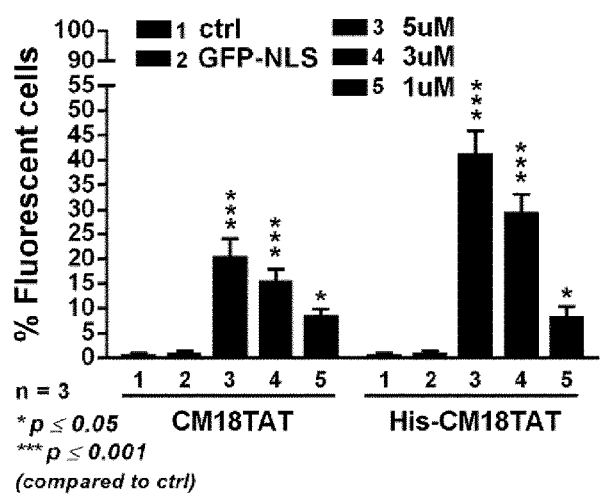
FIGS. 21A and 21B show the results of a GFP-NLS transduction efficiency experiment in which the GFP-NLS cargo protein (5 µM) was co-incubated with 1, 3, or 5 µM of CM18-TAT-Cys (labeled "CM18TAT"), of His-CM18-TAT (labeled "His-CM18TAT"), prior to being exposed to HeLa cells. Cells were evaluated by flow cytometry and the percentage of fluorescent (GFP-positive) cell is shown in FIG. 21A, and corresponding cell toxicity data is shown in FIG. 21B.
Figure 21B:
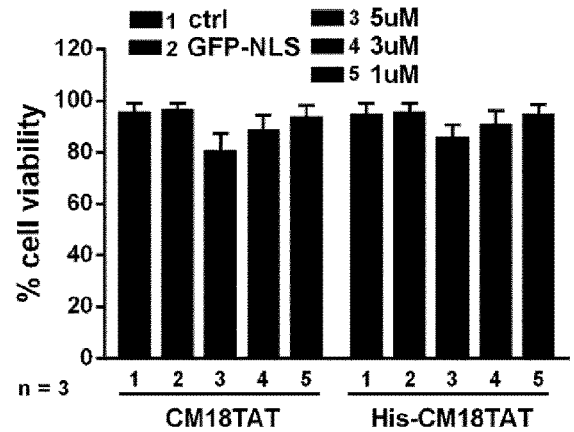

Data from FIGS. 21A and 21B

| | | | FIG. 21A | | FIG. 21B |
|---|---|---|---|---|---|
| Shuttle agent | Cells | Shuttle Conc. (µM) | Mean (%) cell with GFP signal (n = 3) | Standard deviation | Cell viability (%) (±St. Dev.; n = 3) |
| Ctrl (no shuttle, no GFP-NLS) | HeLa | 0 | 0.63 | 0.10 | 96 ± 3.17 |
| GFP-NLS alone | | 0 | 0.93 | 0.26 | 97 ± 2.05 |
| CM18-TAT-Cys | | 5 | 20.54 | 3.51 | 81 ± 6.34 |
| | | 3 | 15.66 | 2.18 | 89 ± 5.37 |
| | | 1 | 8.64 | 1.11 | 94 ± 4.28 |
| Ctrl (no shuttle, no GFP-NLS) | HeLa | 0 | 0.51 | 0.28 | 95 ± 4.19 |
| GFP-NLS alone | | 0 | 1.07 | 0.42 | 96 ± 3.16 |
| His-CM18-TAT | | 5 | 41.38 | 4.59 | 86 ± 4.59 |
| | | 3 | 29.58 | 3.61 | 91 ± 5.18 |
| | | 1 | 8.45 | 1.83 | 95 ± 3.05 |

Strikingly, the results in Table 8.1 and in FIG. 21 show that His-CM18-TAT was able to increase GFP-NLS protein transduction efficiency by about 2-fold at 3 µM and 5 µM concentrations, as compared to CM18-TAT-Cys. These results suggest that adding a histidine-rich domain to a shuttle agent comprising an ELD and CPD, may significantly increase its polypeptide cargo transduction efficiency. Alternatively or in parallel, combining the shuttle agents with a further independent synthetic peptide containing a histidine-rich domain fused to a CPD (but lacking an ELD) may provide a similar advantage for protein transduction, with the added advantage of allowing the concentration of the histidine-rich domain to be varied or controlled independently from the concentration of the shuttle agent. Without being bound by theory, the histidine-rich domain may act as a proton sponge in the endosome, providing another mechanism of endosomal membrane destabilization.

Example 9

His-CM18-PTD4 Increases Transduction Efficiency and Nuclear Delivery of GFP-NLS, mCherry™-NLS and FITC-Labeled Anti-Tubulin Antibody 9.1 Protein Transduction Protocols
Protocol A: Protein Transduction Assay for Delivery in Cell Culture Medium One day before the transduction assay was performed, cells in exponential growth phase were harvested and plated in a 96-well plate (20,000 cells per well). The cells were incubated overnight in appropriate growth media containing FBS (see Example 1). The next day, in separate sterile 1.5-mL tubes, cargo protein at the desired concentration was pre-mixed (pre-incubated) for 10 min at 37° C. with the desired concentration of shuttle agents in 50 μL of fresh serum-free medium (unless otherwise specified). The media in wells was removed and the cells were washed one to three times (depending on the type of cells used) with PBS previously warmed at 37° C. The cells were incubated with the cargo protein/shuttle agent mixture at 37° C. for the desired length of time. After the incubation, the cells were washed three times with PBS and/or heparin (0.5 mg/mL) previously warmed at 37° C. The washes with heparin were used for human THP-1 blood cells to avoid undesired cell membrane-bound protein background in subsequent analyses (microscopy and flow cytometry). The cells were finally incubated in 50 μL of fresh medium with serum at 37° C. before analysis.

Protocol B: Protein Transduction Assay for Adherent Cells in PBS

One day before the transduction assay was performed, cells in exponential growth phase were harvested and plated in a 96-well plate (20,000 cells per well). The cells were incubated overnight in appropriate growth media containing serum (see Example 1). The next day, in separate sterile 1.5-mL tubes, shuttle agents were diluted in sterile distilled water at room temperature (if the cargo is or comprised a nucleic acid, nuclease-free water was used). Cargo protein(s) were then added to the shuttle agents and, if necessary, sterile PBS was added to obtain the desired concentrations of shuttle agent and cargo in a sufficient final volume to cover the cells (e.g., 10 to 100 μL per well for a 96-well plate). The shuttle agent/cargo mixture was then immediately used for experiments. At least three controls were included for each experiment, including: (1) shuttle agent alone (e.g., at highest concentration tested); (2) cargo alone; and (3) without any cargo or shuttle agent. The media in wells was removed, cells were washed once with PBS previously warmed at 37° C., and the shuttle agent/cargo mixture was then added to cover all cells for the desired length of time. The shuttle agent/cargo mixture in wells was removed, the cells were washed once with PBS, and fresh complete medium was added. Before analysis, the cells were washed once with PBS and fresh complete medium was added.

Protocol C: Protein Transduction Assay for Suspension Cells in PBS

One day before the transduction assay was performed, suspension cells in exponential growth phase were harvested and plated in a 96-well plate (20,000 cells per well). The cells were incubated overnight in appropriate growth media containing serum (see Example 1). The next day, in separate sterile 1.5-mL tubes, shuttle agents were diluted in sterile distilled water at room temperature (if the cargo is or comprised a nucleic acid, nuclease-free water was used). Cargo protein(s) were then added to the shuttle agents and, if necessary, sterile PBS or cell culture medium (serum-free) was added to obtain the desired concentrations of shuttle agent and cargo in a sufficient final volume to resuspend the cells (e.g., 10 to 100 μL per well in a 96-well plate). The shuttle agent/cargo mixture was then immediately used for experiments. At least three controls were included for each experiment, including: (1) shuttle agent alone (e.g., at highest concentration tested); (2) cargo alone; and (3) without any cargo or shuttle agent. The cells were centrifuged for 2 minutes at 400 g, the medium was then removed and the cells were resuspended in PBS previously warmed at 37° C. The cells were centrifuged again 2 minutes at 400 g, the PBS removed, and the cells were resuspended in the shuttle agent/cargo mixture. After the desired incubation time, 100 μL of complete medium was added directly on the cells. Cells were centrifuged for 2 minutes at 400 g and the medium was removed. The pellet was resuspended and washed in 200 μL of PBS previously warmed at 37° C. After another centrifugation, the PBS was removed and the cells were resuspended in 100 μL of complete medium. The last two steps were repeated one time before analysis.

Figure 22A:
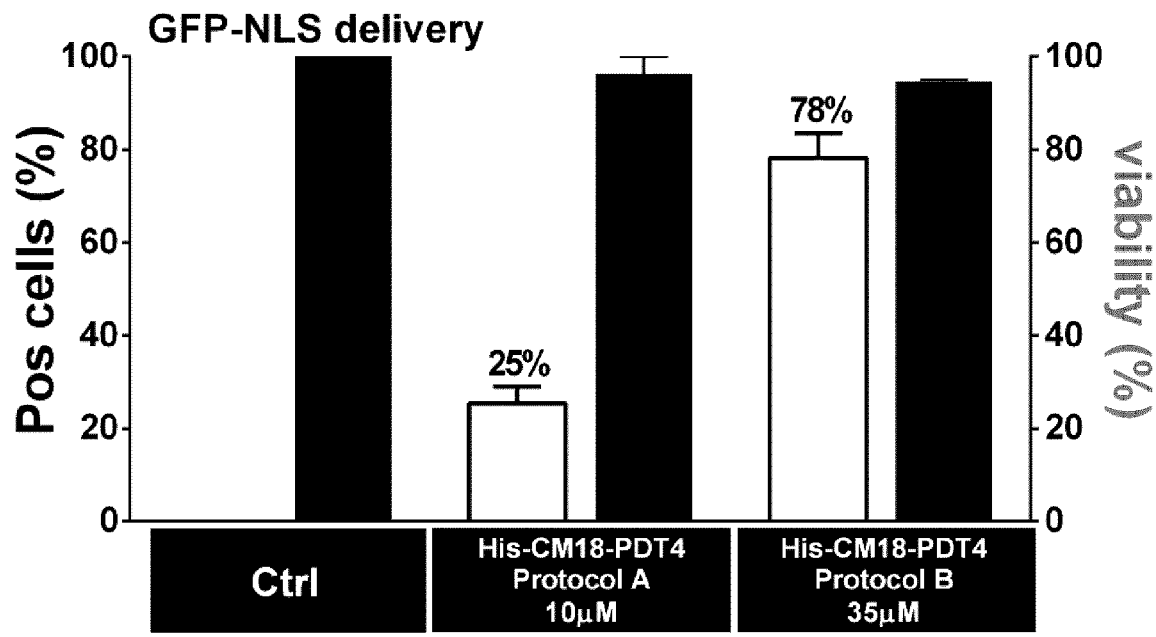
FIGS. 22A and 22B show the results of a transduction efficiency experiment in which GFP-NLS cargo protein was intracellularly delivered using the shuttle His-CM18-PTD4 in HeLa cells. GFP-NLS transduction efficiency was evaluated by flow cytometry and the percentage of GFP fluorescent cells ("Pos cells (%)"), as well as corresponding cell viability data ("viability (%)") are shown.

9.2 GFP-NLS Transduction by His-CM18-PTD4 in HeLa Cells Using Protocol A or B: Flow Cytometry To compare the effects of different protocols on shuttle agent transduction efficiency, HeLa cells were cultured and tested in the protein transduction assays using Protocol A or B as described in Example 9.1. Briefly, GFP-NLS recombinant protein (5 μM; see Example 5.1) was co-incubated with 10 μM of His-CM18-PTD4 and exposed to HeLa cells for 1 hour using Protocol A, or was co-incubated with 35 μM of His-CM18-PTD4 and exposed to HeLa cells for 10 seconds using Protocol B. The cells were subjected to flow cytometry analysis as described in Example 3.3. Results are shown in Table 9.1 and FIG. 22A. ("Pos cells (%)" is the percentage of cells emanating a GFP signal).

TABLE 9.1

Comparison of Protein Transduction Protocols A and B: Data from FIG. 22A

| Protocol | Shuttle | Cells | Conc. of shuttle (μM) | Conc. of GFP-NLS (μM) | Mean % cells with GFP signal (± St. Dev.; n = 3) | Cell viability (%) (± St. Dev.; n = 3) |
|---|---|---|---|---|---|---|
| B | None ("Ctrl") | HeLa | 0 | 5 | 0.53 ± 0.07 | 100 |
| A | His-CM18-PTD4 | HeLa | 10 | 5 | 25.4 ± 3.6 | 96.4 ± 2.7 |
| B | His-CM18-PTD4 | HeLa | 35 | 5 | 78.3 ± 5.3 | 94.6 ± 0.4 |

The above results show that higher protein transduction efficiency for the cargo GFP-NLS using the shuttle agent His-CM18-PTD4 was obtained using Protocol B, as compared to Protocol A.

Figure 22B:
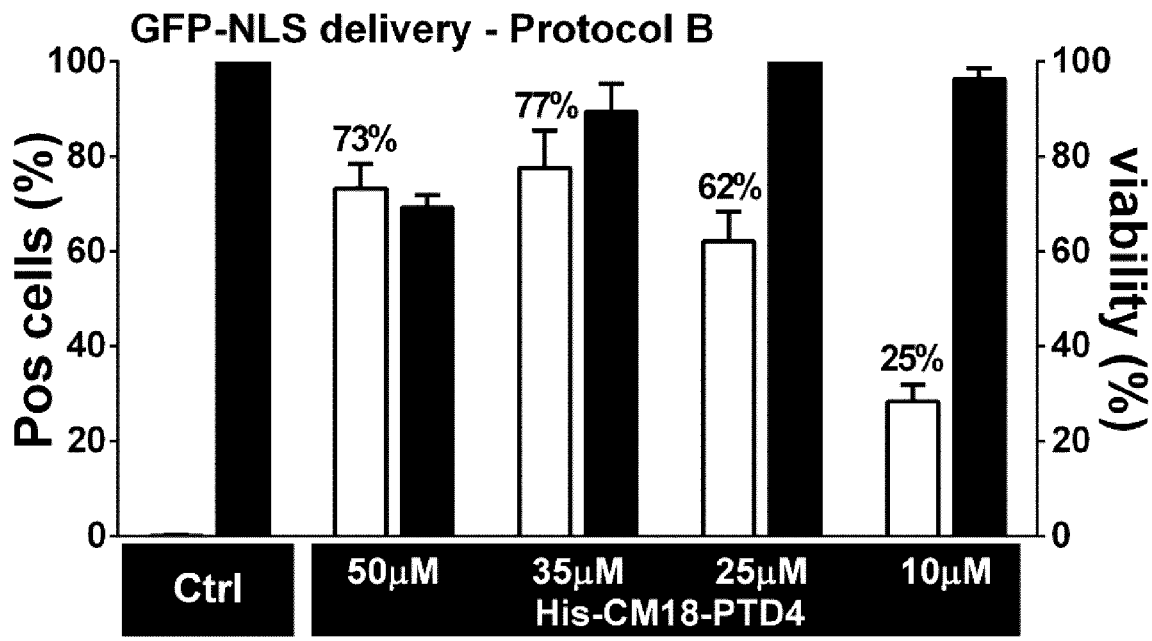

9.3 GFP-NLS Transduction by His-CM18-PTD4 in HeLa Cells Using Protocol B: Flow Cytometry A dose response experiment was performed to evaluate the effect of His-CM18-PTD4 concentration on protein transduction efficiency. HeLa cells were cultured and tested in the protein transduction assay described in Protocol B of Example 9.1. Briefly, GFP-NLS recombinant protein (5 µM; see Example 5.1) was co-incubated with 0, 50, 35, 25, or 10 µM of His-CM18-PTD4, and then exposed to HeLa cells for 10 seconds. The cells were subjected to flow cytometry analysis as described in Example 3.3. Results are shown in Table 9.2 and FIG. 22B.

TABLE 9.2

Dose response of shuttle agent using Protocol B: Data from FIG. 22B

| Protocol | Shuttle | Cells | Conc. of shuttle (µM) | Conc. of GFP-NLS (µM) | Mean % cells with GFP signal (± St. Dev.; n = 3) | Cell viability (%) (± St. Dev.; n = 3) |
|---|---|---|---|---|---|---|
| B | None ("Ctrl") | HeLa | 0 | 5 | 0.13 ± 0.1 | 100 ± 0 |
|   | His-CM18-PTD4 |   | 50 | 5 | 73.2 ± 5.2 | 69.2 ± 2.7 |
|   |   |   | 35 | 5 | 77.7 ± 7.8 | 79.6 ± 5.9 |
|   |   |   | 25 | 5 | 62.1 ± 6.1 | 95.3 ± 3.7 |
|   |   |   | 10 | 5 | 25.3 ± 3.6 | 96.3 ± 2.3 |

The above results show that His-CM18-PTD4 is able to increase GFP-NLS transduction efficiency in HeLa cells in a dose-dependent manner.

9.4 GFP-NLS Transduction by His-CM18-PTD4 in HeLa Cells Using Protocol B: Visualization by Microscopy GFP-NLS recombinant protein (5 µM; see Example 5.1) was co-incubated with 35 µM of His-CM18-PTD4, and then exposed to HeLa cells for 10 seconds using Protocol B as described in Example 9.1. The cells were then subjected to fluorescence microscopy analysis as described in Examples 3.2 and 3.2a.

For the sample results shown in FIGS. 23 and 24, GFP fluorescence of the HeLa cells was immediately visualized by bright field and fluorescence microscopy at 4×, 20× and 40× magnifications after the final washing step.

In FIG. 23, the upper panels in FIGS. 23A, 23B and 23C show nuclei labelling (DAPI) at 4×, 20× and 40× magnifications, respectively, while the lower panels show corresponding GFP-NLS fluorescence. In FIG. 23C, white triangle windows indicate examples of areas of co-labelling between nuclei (DAPI) and GFP-NLS signals. In FIG. 23D, the upper and bottom panels show sample bright field images of the HeLa cells, and the middle panel shows the results of a corresponding FACS analysis (performed as described in Example 3.3), which indicates the percentage of cells in a 96-plate with a GFP signal. No significant GFP fluorescence was observed in negative control samples (i.e., cells exposed to GFP-NLS without any shuttle agent; data not shown).

FIG. 24 shows bright field (FIG. 24A) and fluorescent images (FIG. 24B). The inset in FIG. 24B shows the results of a corresponding FACS analysis (performed as described in Example 3.3), which indicates the percentage of cells in a 96-plate well with a GFP signal. No significant GFP fluorescence was observed in negative control samples (i.e., cells exposed to GFP-NLS without any shuttle agent; data not shown).

For the sample results shown in FIG. 25, the HeLa cells were fixed, permeabilized and subjected to immuno-labelling as described in Example 3.2a before visualization by fluorescence microscopy as described in Example 3.2. GFP-NLS was labelled using a primary mouse monoclonal anti-GFP antibody (Feldan, #A017) and a secondary goat anti-mouse Alexa™-594 antibody (Abcam #150116). The upper panels in FIGS. 25A and 25B show nuclei labelling (DAPI), and the lower panels show corresponding labelling for GFP-NLS. FIGS. 25A and 25B show sample images at 20× and 40× magnifications, respectively. White triangle windows indicate examples of areas of co-labelling between nuclei and GFP-NLS. No significant GFP-NLS labelling was observed in negative control samples (i.e., cells exposed to GFP-NLS without any shuttle agent; data not shown).

FIG. 26 shows sample images captured with confocal microscopy at 63× magnification of living cells. FIG. 26A shows a bright field image, while FIG. 26B shows the corresponding fluorescent GFP-NLS. FIG. 26C is an overlay between the images in FIG. 26A and FIG. 26B. No significant GFP-NLS fluorescence was observed in negative control samples (i.e., cells exposed to GFP-NLS without any shuttle agent; data not shown).

Figure 24C:
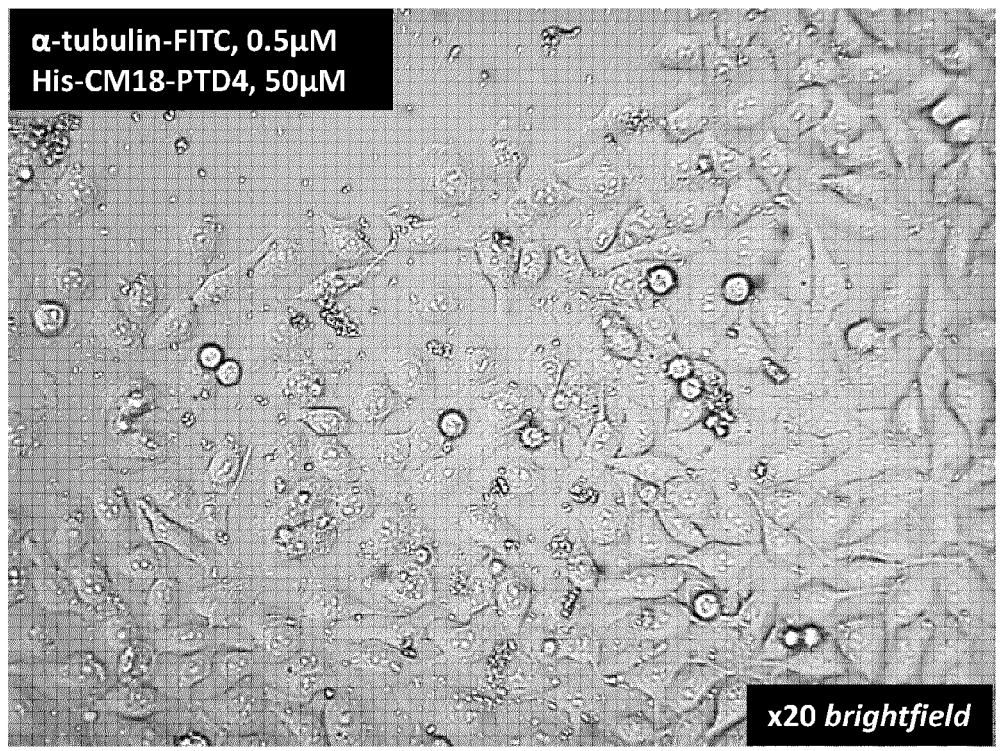
Figure 24D:
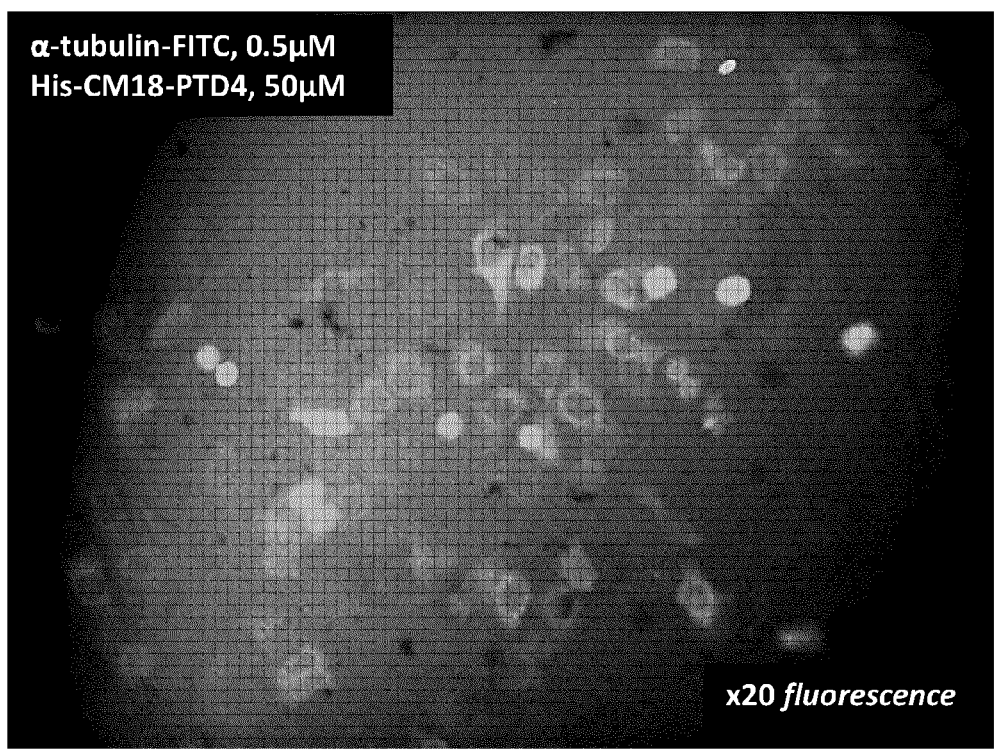

9.4a FTIC-Labeled Anti-Tubulin Antibody Transduction by His-CM18-PTD4 in HeLa Cells Using Protocol B: Visualization by Microscopy FITC-labeled anti-tubulin antibody (0.5 µM; Abcam, ab64503) was co-incubated with 50 µM of His-CM18-PTD4, and then exposed to HeLa cells for 10 seconds using Protocol B as described in Example 9.1. The cells were then subjected to fluorescence microscopy analysis as described in Examples 3.2 and 3.2a, wherein the FITC fluorescence of the anti-tubulin antibody in the HeLa cells was immediately visualized by bright field and fluorescence microscopy at 20× magnification after the final washing step. Sample results are shown in FIGS. 24C and 24D. No significant FITC fluorescence was observed in negative control samples (i.e., cells exposed to the FITC-labeled anti-tubulin antibody without any shuttle agent; data not shown).

Overall, the results in Examples 9.4 and 9.4a show that GFP-NLS and FITC-labeled anti-tubulin antibody cargos are successfully transduced and delivered to the nucleus and/or the cytosol of HeLa cells in the presence of the shuttle agent His-CM18-PTD4.

9.5 GFP-NLS Kinetic Transduction by His-CM18-PTD4 in HeLa Cells: Visualization by Microscopy GFP-NLS recombinant protein (5 µM; see Example 5.1) was co-incubated with 50 µM of His-CM18-PTD4, and then exposed to HeLa cells for 10 seconds using Protocol B as described in Example 9.1. After a washing step, the GFP fluorescence of the HeLa cells was immediately visualized by fluorescence microscopy (Example 3.2) at 20× magnification after different intervals of time. Typical results are shown in FIG. 27, in which fluorescence microscopy images were captured after 45, 75, 100, and 120 seconds (see FIGS. 27A, 27B, 27C and 27D, respectively).

Figure 27A:
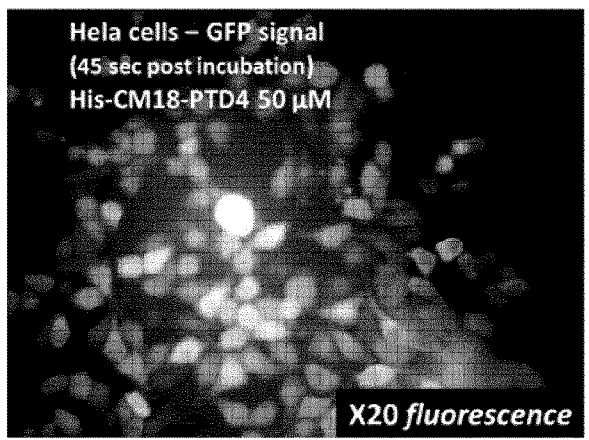
FIGS. 27A-27D show microscopy images of a kinetic (time-course) transduction experiment in HeLa cells, where the fluorescence of GFP-NLS cargo protein was tracked after 45 (FIG. 27A), 75 (FIG. 27B), 100 (FIG. 27C), and 120 (FIG. 27D) seconds following intracellular delivery with the shuttle His-CM18-PTD4. The diffuse cytoplasmic fluorescence pattern observed after 45 seconds (FIG. 27A) gradually becomes a more concentrated nuclear pattern at 120 seconds (FIG. 27D).
Figure 27B:
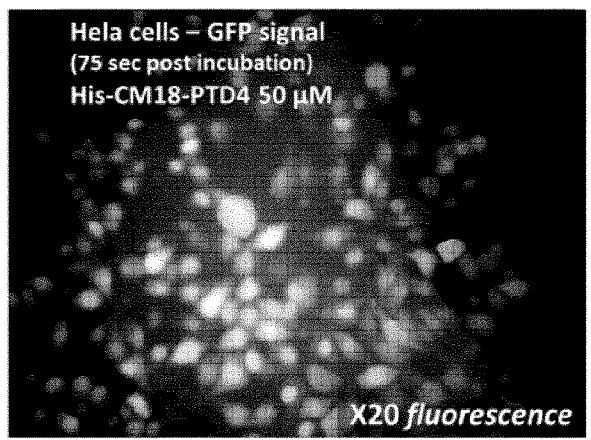
Figure 27C:
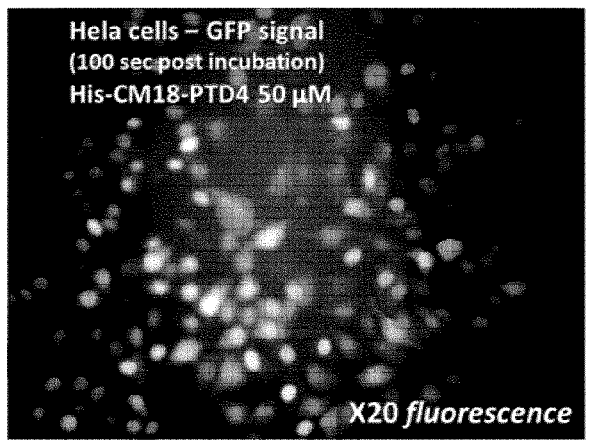
Figure 27D:
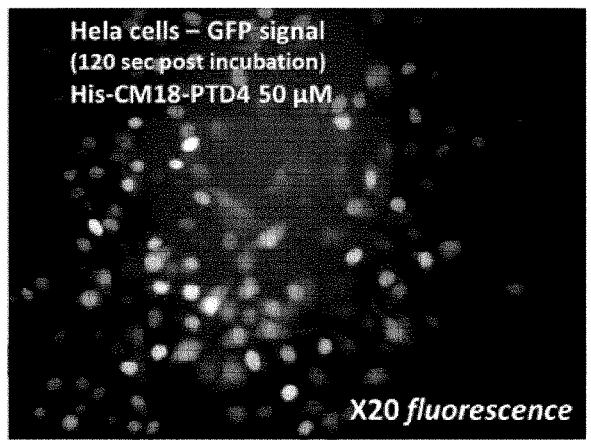
Figure 28A:
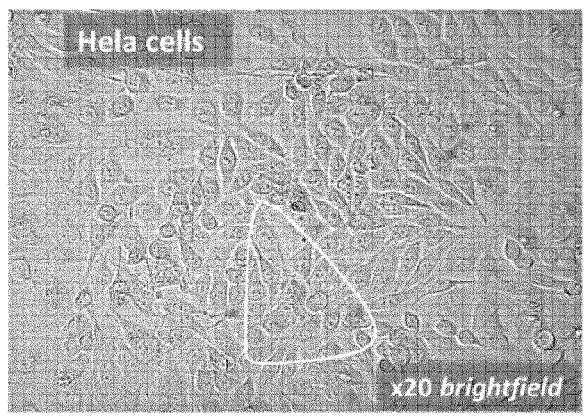
FIGS. 28A-28D show microscopy images of co-delivery transduction experiment in which two cargo proteins (GFP-NLS and mCherry™-NLS) are simultaneously delivered intracellularly by the shuttle His-CM18-PTD4 in HeLa cells. Cells and fluorescent signals were visualized by (FIG. 28A) bright field and (FIG. 28B-28D) fluorescence microscopy. White triangle windows indicate examples of areas of co-labelling between nuclei (DAPI) and GFP-NLS or mCherry™
Figure 28B:
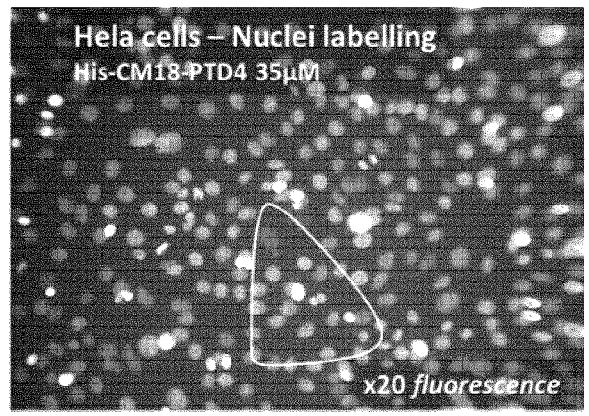
Figure 28C:
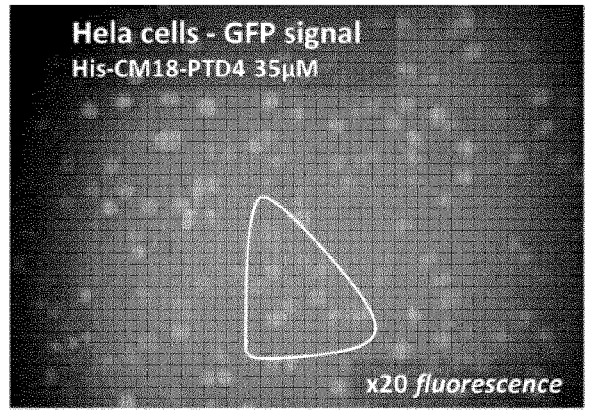
Figure 28D:
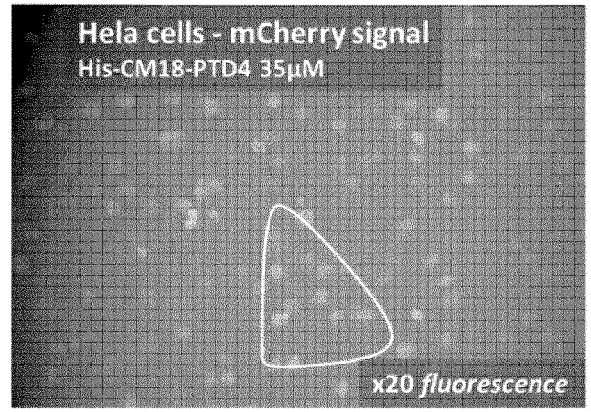

As shown in FIG. 27A, diffuse cellular GFP fluorescence was generally observed after 45 seconds, with areas of lower GFP fluorescence in the nucleus in many cells. These results suggest predominantly cytoplasmic and low nuclear distribution of the GPF-NLS delivered intracellularly via the shuttle agent after 45 seconds. FIGS. 27B-27D show the gradual redistribution of GFP fluorescence to the cell nuclei at 75 seconds (FIG. 27B), 100 seconds (FIG. 27 C), and 120 seconds (FIG. 27D) following exposure to the His-CM18-PTD4 shuttle agent and GFP-NLS cargo. No significant cellular GFP fluorescence was observed in negative control samples (i.e., cells exposed to GFP-NLS without any shuttle agent; data not shown).

The results in Example 9.5 show that GFP-NLS is successfully delivered to the nucleus of HeLa cells in the presence of the shuttle agent His-CM18-PTD4 by 2 minutes.

9.6 GFP-NLS and mCherry™-NLS Co-Transduction by His-CM18-PTD4 in HeLa Cells: Visualization by Microscopy mCherry™-NLS recombinant protein was constructed, expressed and purified from a bacterial expression system as described in Example 1.4. The sequence of the mCherry™-NLS recombinant protein was:

[SEQ ID NO: 73]
MHHHHHHGGGGSGGGGSGGASTGIRHVSKCEEDNMAIIKEFMRFKVHMEGS

VNGHEFEIEGEGEGRPYEGTQTAKLKVTKGGPLPFAWDILSPQFMYGSKAY

VKHPADIPDYLKLSFPEGFKWERVMNFEDGGVVTVTQDSSLQDGEFIYKVK

LRGTNFPSDGQVMQKKTMGWEASSERMYPEDGALKGEIKQRLKLKDGGHYD

AEVKTTYKAKKPVQLPGAYNVNIKLDITSHNEDYTIVEQYERAEGRHSTGG

MDELYKGGSGGGSGGGSGWIRASSGGR<u>SSDDEATADSQHAAPPKKKRKV</u>GG

SGGGSGGGSGGGRGTEIS

(MW = 34.71 kDa; pI = 6.68)
NLS sequence is underlined
Serine/glycine rich linkers are in bold GFP-NLS recombinant protein (5 μM; see Example 5.1) and mCherry™-NLS recombinant protein (5 μM) were co-incubated together with 35 μM of His-CM18-PTD4, and then exposed to HeLa cells for 10 seconds using Protocol B as described in Example 9.1. After washing steps, the cells were immediately visualized by bright field and fluorescence microscopy at 20× magnifications as described in Example 3.2. Sample results are shown in FIG. 28, in which corresponding images showing bright field (FIG. 28A), DAPI fluorescence (FIG. 28B), GFP-NLS fluorescence (FIG. 28C), and mCherry™-NLS fluorescence (FIG. 28D) are shown. White triangle windows indicate examples of areas of co-labelling between GFP-NLS and mCherry™ fluorescence signals in cell nuclei. No significant cellular GFP or mCherry™ fluorescence was observed in negative control samples (i.e., cells exposed to GFP-NLS or mCherry™ without any shuttle agent; data not shown).

These results show that GFP-NLS and mCherry™-NLS are successfully delivered together to the nucleus in HeLa cells in the presence of the shuttle agent His-CM18-PTD4.

9.7 GFP-NLS Transduction by His-CM18-PTD4 in THP-1 Suspension Cells: Flow Cytometry The ability of the His-CM18-PTD4 to deliver GFP-NLS in the nuclei of suspension cells was tested using THP-1 cells. THP-1 cells were cultured and tested in the protein transduction assays using Protocols A and C as described in Example 9.1. GFP-NLS (5 μM; see Example 5.1) was co-incubated with 1 μM of His-CM18-PTD4 and exposed to THP-1 cells for 1 hour (Protocol A), or was co-incubated with 5 μM of His-CM18-PTD4 and exposed to THP-1 cells for 15 seconds (Protocol C). The cells were subjected to flow cytometry analysis as described in Example 3.3. Results are shown in Table 9.3 and in FIG. 31.

TABLE 9.3

Figure 31:
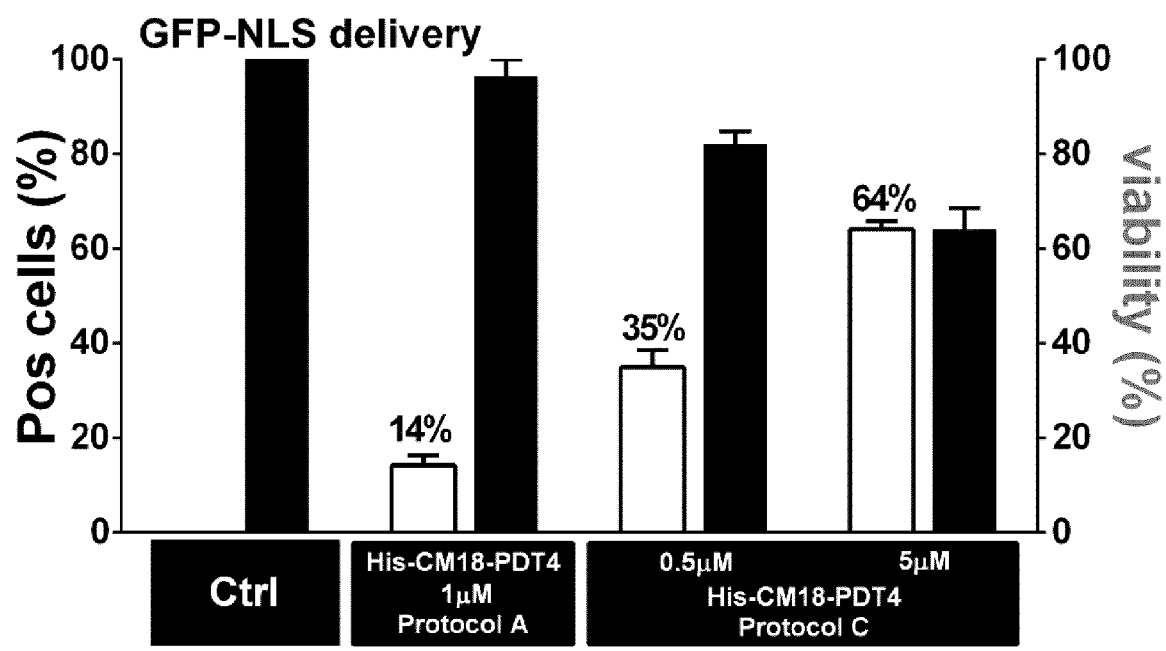
FIG. 31 shows the results of a transduction efficiency experiment in which GFP-NLS cargo protein was intracellularly delivered using the shuttle His-CM18-PTD4 in THP-1 cells using different Protocols (Protocol A vs C). GFP-NLS transduction efficiency was evaluated by flow cytometry and the percentage of GFP fluorescent cells ("Pos cells (%)"), as well as corresponding cell viability data ("viability (%)") are shown. "Ctrl" corresponds to THP-1 cells exposed to GFP-NLS cargo protein in the absence of a shuttle agent.

Data from FIG. 31

| Protocol | Shuttle | Cells | Conc. of shuttle (μM) | Conc. of GFP-NLS (μM) | Mean % cells with GFP signal (± St. Dev.; n = 3) | Cell viability (%) (± St. Dev.; n = 3) |
|---|---|---|---|---|---|---|
| C | No shuttle ("Ctrl") | THP-1 | 0 | 5 | 0.2 ± 0.03 | 99.1 ± 0.7 |
| A | His-CM18-PTD4 | | 1 | 5 | 14.2 ± 2.2 | 96.9 ± 3.6 |
| C | His-CM18-PTD4 | | 0.5 | 5 | 34.9 ± 3.8 | 82.1 ± 2.7 |
| | | | 5 | 5 | 64.1 ± 1.6 | 64.0 ± 4.1 |

9.8 GFP-NLS Transduction by His-CM18-PTD4 in THP-1 Cells: Visualization by Microscopy GFP-NLS recombinant protein (5 μM; see Example 5.1) was co-incubated with 5 μM of His-CM18-PTD4, and then exposed to THP-1 cells for 15 seconds using Protocol C as described in Example 9.1. The cells were subjected to microscopy visualization as described in Example 3.2.

For the sample results shown in FIG. 32, GFP fluorescence of the HeLa cells was immediately visualized by bright field (upper panels) and fluorescence (lower panels) microscopy at 4×, 10× and 40× magnifications (FIG. 32A-32C, respectively) after the final washing step. White triangle windows in FIG. 32C indicate examples of areas of co-labelling between bright field and fluorescence images. FIG. 32D shows typical results of a corresponding FACS analysis (performed as described in Example 3.3), which indicates the percentage of cells in a 96-plate well with a GFP signal. Additional results are shown in FIG. 33, in which FIGS. 33A and 33B show bright field images, and FIGS. 33C and 33D show corresponding fluorescence images. White triangle windows indicate examples of areas of co-labelling between FIGS. 33A and 33C, as well as FIGS. 33B and 33D. The right-most panel shows typical results of a corresponding FACS analysis (performed as described in Example 3.3), which indicates the percentage of cells in a 96-plate well with a GFP signal.

No significant cellular GFP fluorescence was observed in negative control samples (i.e., cells exposed to GFP-NLS without any shuttle agent; data not shown).

The results in this example show that GFP-NLS is successfully delivered intracellularly in THP-1 cells in the presence of the shuttle agent His-CM18-PTD4.

Example 10

Different Multi-Domain Shuttle Agents, but not Single-Domain Peptides, Successfully Transduce GFP-NLS in HeLa and THP-1 Cells 10.1 GFP-NLS Transduction by Different Shuttle Agents in HeLa Cells: Flow Cytometry HeLa cells were cultured and tested in the protein transduction assays using Protocol B as described in Example 9.1. Briefly, GFP-NLS recombinant protein (5 μM; see Example 5.1) was co-incubated with 50 μM of different shuttle agents and exposed to the HeLa cells for 10 seconds. The cells were subjected to flow cytometry analysis as described in Example 3.3. Results are shown in Table 10.1 and FIG. 29A. "Pos cells (%)" is the mean percentages of all cells that emanate a GFP signal. The negative control ("Ctrl") corresponds to cells that were incubated with GFP-NLS recombinant protein (5 μM) without any shuttle agent.

TABLE 10.1

Figure 29A:
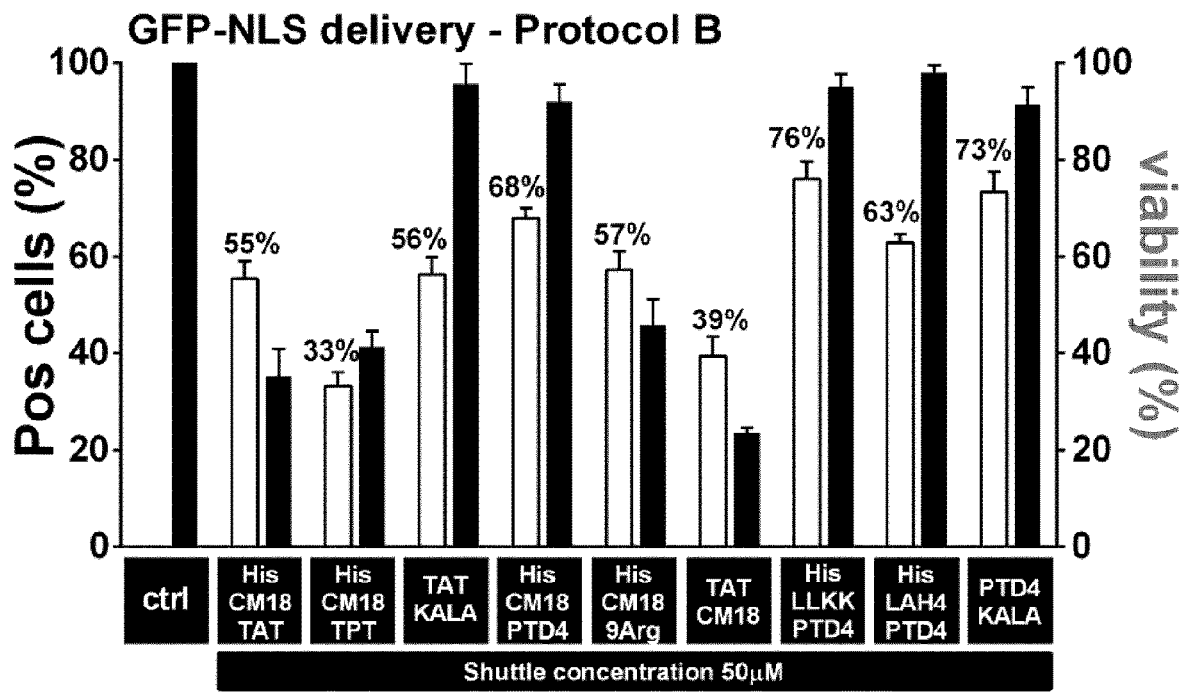

Data from FIG. 29A

| Protocol | Shuttle agent | Cells | Conc. of shuttle (μM) | Conc. of GFP-NLS (μM) | Mean % cells with GFP signal (± St. Dev.; n = 3) | Cell viability (%) (± St. Dev.; n = 3) |
|---|---|---|---|---|---|---|
| B | No shuttle ("ctrl") | HeLa | 0 | 5 | 0 | 100 |
|   | His-CM18-TAT | HeLa | 50 |   | 55.5 ± 3.6 | 35.2 ± 5.7 |
|   | His-CM18-Transportan (TPT) | HeLa |   |   | 33.2 ± 2.8 | 41.3 ± 3.3 |
|   | TAT-KALA | HeLa |   |   | 56.3 ± 3.6 | 95.6 ± 4.3 |
|   | His-CM18-PTD4 | HeLa |   |   | 68 ± 2.2 | 92 ± 3.6 |
|   | His-CM18-9Arg | HeLa |   |   | 57.2 ± 3.9 | 45.8 ± 5.4 |
|   | TAT-CM18 | HeLa |   |   | 39.4 ± 3.9 | 23.5 ± 1.1 |
|   | His-C(LLKK)$_3$C-PTD4 | HeLa |   |   | 76 ± 3.8 | 95 ± 2.7 |
|   | His-LAH4-PTD4 | HeLa |   |   | 63 ± 1.64 | 98 ± 1.5 |
|   | PTD4-KALA | HeLa |   |   | 73.4 ± 4.12 | 91.4 ± 3.67 |

\* His-LAH4-PTD4: the intracellular GFP fluorescence pattern was observed by fluorescence microscopy as being punctate, suggesting that the GFP cargo remained trapped in endosomes.

10.2 GFP-NLS Transduction by Different Shuttle Agents with Varying Incubation Times in HeLa Cells: Flow Cytometry HeLa cells were cultured and tested in the protein transduction assays using Protocol B as described in Example 9.1. Briefly, GFP-NLS recombinant protein (5 μM; see Example 5.1) was co-incubated with 10 μM of TAT-KALA, His-CM18-PTD4, or His-C(LLKK)$_3$C-PTD4 for 1, 2, or 5 minutes. After the final washing step, the cells were subjected to flow cytometry analysis as described in Example 3.3. Results are shown in Table 10.2 and FIG. 29B. "Pos cells (%)" is the mean percentages of all cells that emanate a GFP signal. The negative control ("Ctrl") corresponds to cells that were incubated with GFP-NLS recombinant protein (5 μM) without any shuttle agent.

10.3 GFP-NLS Transduction by TAT-KALA, His-CM18-PTD4 and His-C(LLKK)$_3$C-PTD4 with Varying Incubation Times in HeLa Cells: Flow Cytometry HeLa cells were cultured and tested in the protein transduction assays using Protocol C as described in Example 9.1. Briefly, GFP-NLS recombinant protein (5 μM; see Example 5.1) was co-incubated with 5 μM of TAT-KALA, His-CM18-PTD4, or His-C(LLKK)$_3$C-PTD4 for 1, 2, or 5 minutes. After the final washing step, the cells were subjected to flow cytometry analysis as described in Example 3.3. Results are shown in Table 10.3 and FIG. 29C. The negative control ("Ctrl") corresponds to cells that were incubated with GFP-NLS recombinant protein (5 μM) without any shuttle agent.

TABLE 10.2

Figure 29B:
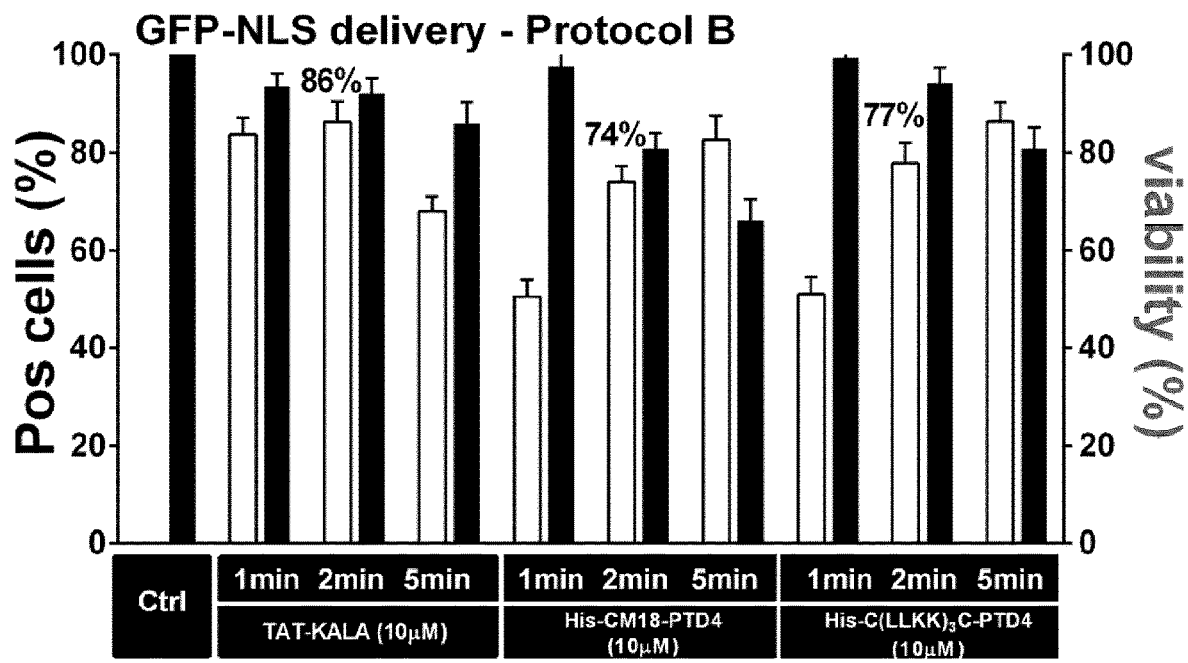

Data from FIG. 29B

| Protocol | Shuttle agent | Cells | Conc. of shuttle (μM) | Incubation time | Mean % cells with GFP signal (± St. Dev.; n = 3) | Cell viability (%) (± St Dev.; n = 3) |
|---|---|---|---|---|---|---|
| — | No shuttle ("Ctrl") | HeLa | 0 | 5 min. | 0 ± n/a | 97.5 ± 1.7 |
| B | TAT-KALA | HeLa | 10 | 1 min. | 83.7 ± 3.5 | 93.5 ± 2.7 |
|   |   |   |   | 2 min. | 86.2 ± 4.3 | 92.1 ± 3.1 |
|   |   |   |   | 5 min. | 68.1 ± 3.0 | 86 ± 4.4 |
|   | His-CM18-PTD4 | HeLa | 10 | 1 min. | 50.6 ± 3.5 | 97.6 ± 2.7 |
|   |   |   |   | 2 min. | 74 ± 3.3 | 80.9 ± 3.2 |
|   |   |   |   | 5 min. | 82.7 ± 5.0 | 66.2 ± 4.4 |
|   | His-C(LLKK)$_3$C-PTD4 | HeLa | 10 | 1 min. | 51.1 ± 3.5 | 99.5 ± 2.7 |
|   |   |   |   | 2 min. | 77.8 ± 4.3 | 94.3 ± 3.2 |
|   |   |   |   | 5 min. | 86.4 ± 4.0 | 80.8 ± 4.4 |

TABLE 10.3

Figure 29C:
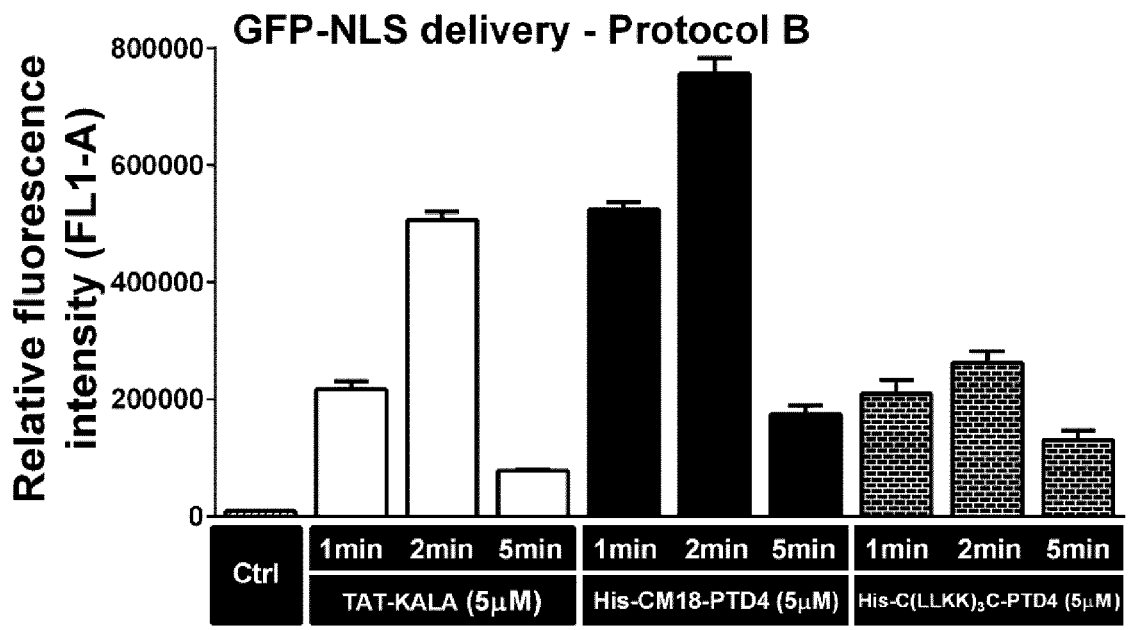

Data from FIG. 29C

| Protocol | Shuttle agent | Cells | Conc. of shuttle (µM) | Incubation time | Relative fluorescence intensity (FL1-A) (n = 3) | St. Dev. |
|---|---|---|---|---|---|---|
| | No shuttle ("Ctrl") | | 0 | 5 min. | 8903 | 501 |
| C | TAT-KALA | HeLa | 10 | 1 min. | 216 367 | 13 863.48 |
| | | | | 2 min. | 506 158 | 14 536.28 |
| | | | | 5 min. | 78 010 | 2 463.96 |
| | His-CM18-PTD4 | HeLa | 10 | 1 min. | 524 151 | 12 366.48 |
| | | | | 2 min. | 755 624 | 26 933.16 |
| | | | | 5 min. | 173 930 | 15 567.33 |
| | His-C(LLKK)₃C-PTD4 | HeLa | 10 | 1 min. | 208 968 | 23 669.19 |
| | | | | 2 min. | 262 411.5 | 19 836.84 |
| | | | | 5 min. | 129 890 | 16 693.29 |

10.4 GFP-NLS Transduction by Different Shuttle Agents in HeLa Cells: Flow Cytometry HeLa cells were cultured and tested in the protein transduction assays using Protocol B as described in Example 9.1. Briefly, GFP-NLS recombinant protein (5 µM; see Example 5.1) was co-incubated with 50 µM of different shuttle agents (see Table 1.3 for amino acid sequences and properties) and exposed to the HeLa cells for 10 seconds. The cells were subjected to flow cytometry analysis as described in Example 3.3. Results are shown in Tables 10.3a & 10.3b and FIGS. 29E & 29F. "Pos cells (%)" is the mean percentages of all cells that emanate a GFP signal. The negative control ("Ctrl") corresponds to cells that were incubated with GFP-NLS recombinant protein (5 µM) without any shuttle agent.

TABLE 10.3a

Figure 29D:
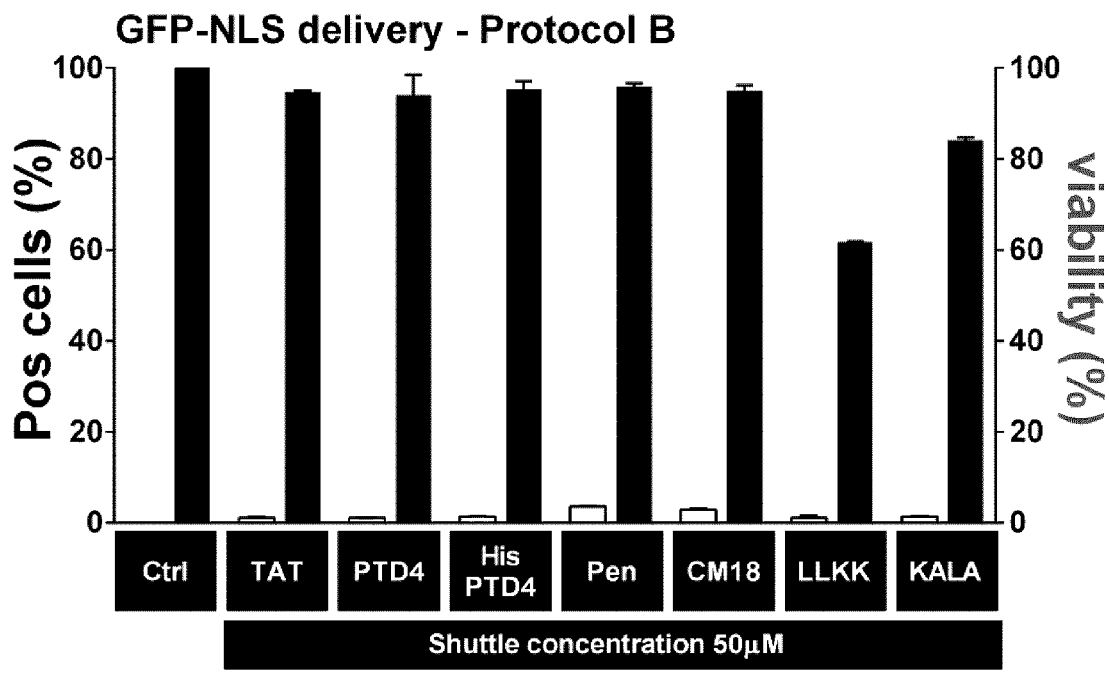
Figure 29E:
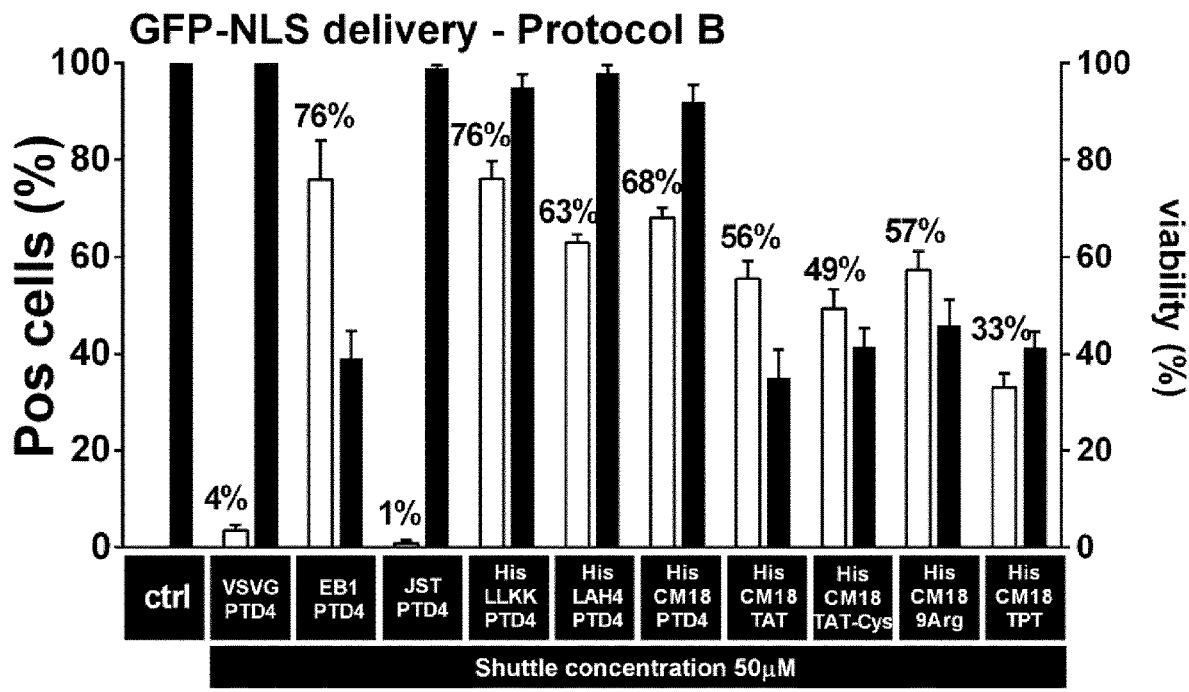

Data from FIG. 29E

| Domain structure | Shuttle agent | Conc. of shuttle (µM) | Conc. of GFP-NLS (µM) | Mean % cells with GFP signal (±St. Dev.; n = 3) | Cell viability (%) (±St. Dev., n = 3) |
|---|---|---|---|---|---|
| — | No shuttle ("Ctrl") | 0 | 5 | 0 | 100 |
| ELD-CPD | VSVG-PTD4 | 50 | 5 | 3.5 ± 1.1 | 100 |
| | EB1-PTD4 | | | 75.8 ± 8.26 | 39 ± 5.6 |
| | JST-PTD4 | | | 0.84 ± 0.69 | 98.9 ± 0.57 |
| His-ELD-CPD | His-C(LLKK)₃C-PTD4 | 50 | 5 | 76 ± 3.8 | 95 ± 2.7 |
| | His-LAH4-PTD4* | | | 63 ± 1.64 | 98 ± 1.5 |
| | His-CM18-PTD4 | | | 68 ± 2.2 | 92 ± 3.6 |
| | His-CM18-TAT | | | 55.5 ± 3.6 | 35.2 ± 5.7 |
| | His-CM18-TAT-Cys** | | | 49.3 ± 4.1 | 41.4 ± 3.91 |

TABLE 10.3a-continued

Data from FIG. 29E

| Domain structure | Shuttle agent | Conc. of shuttle (µM) | Conc. of GFP-NLS (µM) | Mean % cells with GFP signal (±St. Dev.; n = 3) | Cell viability (%) (±St. Dev., n = 3) |
|---|---|---|---|---|---|
| | His-CM18-9Arg | | | 57.2 ± 3.93 | 45.8 ± 3.53 |
| | His-CM18-Transportan (TPT) | | | 33.2 ± 2.82 | 41.3 ± 3.29 |

*His-LAH4-PTD4: the intracellular GFP fluorescence pattern was observed by fluorescence microscopy as being punctate, suggesting that the GFP cargo remained trapped in endosomes.
**Not shown in FIG. 29E.

TABLE 10.3b

Figure 29F:
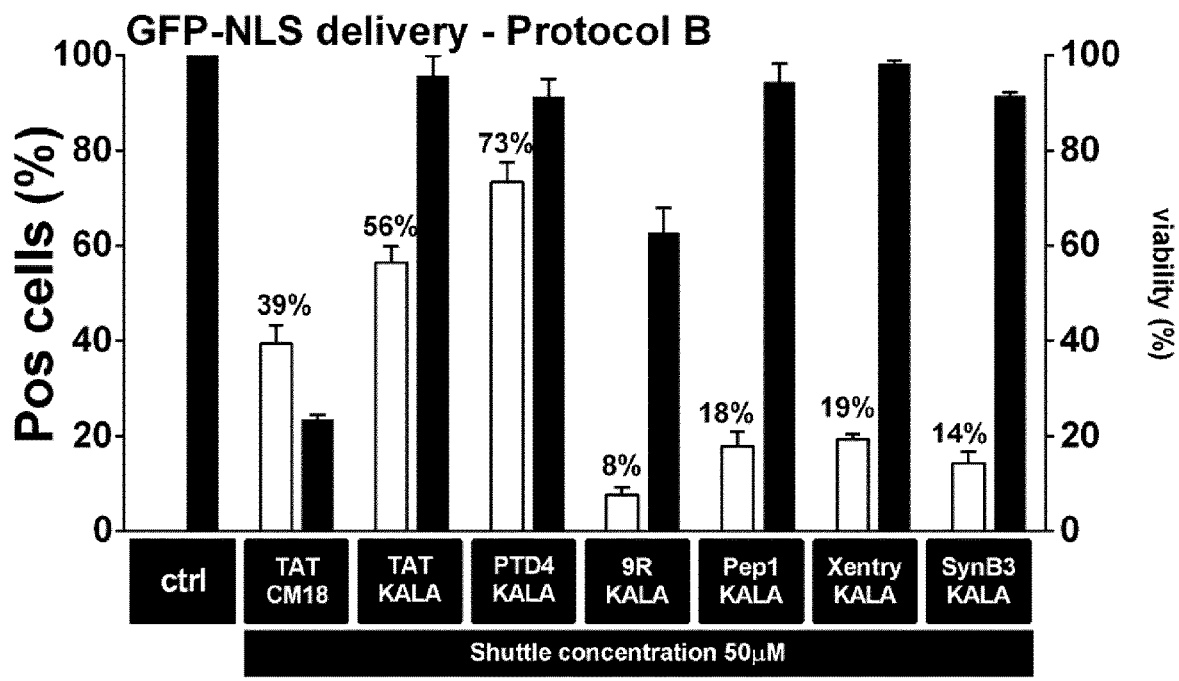

Data from FIG. 29F

| Domain structure | Shuttle agent | Conc. of shuttle (µM) | Conc. of GFP-NLS (µM) | Mean % cells with GFP signal (±St. Dev.; n = 3) | Cell viability (%) (±St. Dev.; n = 3) |
|---|---|---|---|---|---|
| — | No shuttle ("Ctrl") | 0 | 5 | 0 | 100 |
| CPD-ELD | TAT-CM18 | 50 | 5 | 39.4 ± 3.9 | 23.5 ± 1.1 |
| | TAT-KALA | | | 56.3 ± 3.6 | 95.6 ± 4.3 |
| | PTD4-KALA | | | 73.4 ± 4.12 | 91.4 ± 3.67 |
| | 9Arg-KALA | | | 7.8 ± 1.53 | 62.8 ± 5.11 |
| | Pep1-KALA | | | 17.2 ± 3.07 | 94.7 ± 3.77 |
| | Xentry-KALA | | | 19.4 ± 1.01 | 98.3 ± 0.64 |
| | SynB3-KALA | | | 14.3 ± 2.37 | 91.1 ± 0.82 |

HeLa cells were cultured and tested in the protein transduction assays using Protocol B as described in Example 9.1. Briefly, GFP-NLS recombinant protein (5 µM; see Example 5.1) was co-incubated with 10 µM of TAT-KALA, His-CM18-PTD4, or His-C(LLKK)₃C-PTD4 for 1, 2, or 5 minutes. After the final washing step, the cells were subjected to flow cytometry analysis as described in Example 3.3. Results are shown in Tables 10.3c & 10.3b and FIGS. 29G and 29H. "Pos cells (%)" is the mean percentages of all cells that emanate a GFP signal. The negative control ("Ctrl") corresponds to cells that were incubated with GFP-NLS recombinant protein (5 µM) without any shuttle agent.

TABLE 10.3c

Figure 29G:
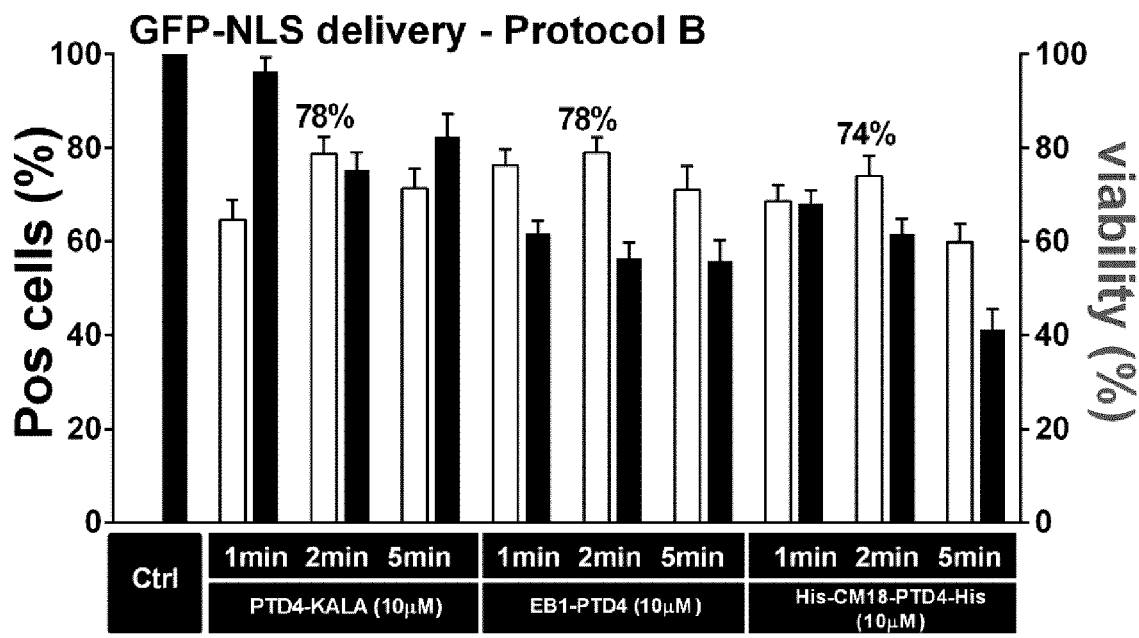

Data from FIG. 29G

| Domain structure | Shuttle agent | Conc. of shuttle (μM) | Conc. of GFP-NLS (μM) | Incubation time (min) | Mean % cells with GFP signal (± St. Dev.; n = 3) | Cell viability (%) (± St. Dev.; n = 3) |
|---|---|---|---|---|---|---|
| — | No shuttle ("Ctrl") | 0 | 5 | 5 | 0 ± n/a | 98.3 ± 0.9 |
| CPD-ELD | PTD4-KALA | 10 | 5 | 1 | 64.6 ± 4.3 | 96.2 ± 3.0 |
|  |  |  |  | 2 | 78.8 ± 3.6 | 75.3 ± 3.8 |
|  |  |  |  | 5 | 71.4 ± 4.2 | 82.4 ± 4.7 |
| ELD-CPD | EB1-PTD4 | 10 | 5 | 1 | 76.3 ± 3.5 | 61.7 ± 2.7 |
|  |  |  |  | 2 | 79.0 ± 3.3 | 56.6 ± 3.2 |
|  |  |  |  | 5 | 71.1 ± 5.0 | 55.8 ± 4.4 |
| His-ELD-CPD-His | His-CM18-PTD4-His | 10 | 5 | 1 | 68.6 ± 3.5 | 68.1 ± 2.7 |
|  |  |  |  | 2 | 74.1 ± 4.3 | 61.6 ± 3.2 |
|  |  |  |  | 5 | 59.8 ± 4.0 | 41.2 ± 4.4 |

TABLE 10.3d

Figure 29H:
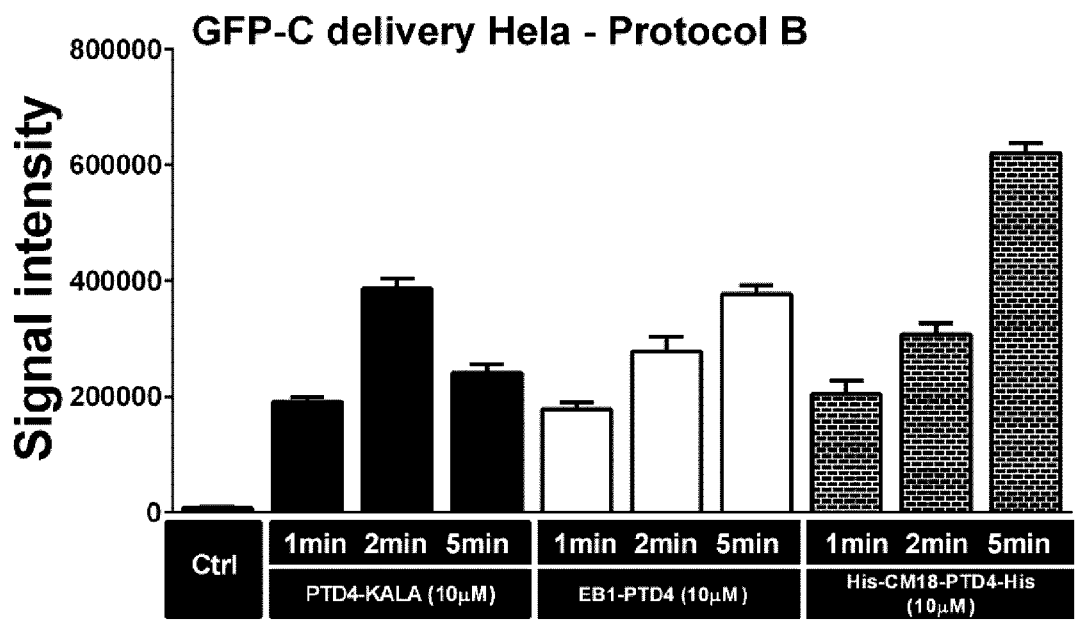

Data from FIG. 29H

| Domain structure | Shuttle agent | Conc. of shuttle (μM) | Conc. of GFP-NLS (μM) | Incubation time (min) | Relative Fluorescence Intensity (FL1-A) (±St. Dev.; n = 3) |
|---|---|---|---|---|---|
| — | No shuttle ("Ctrl") | 0 | 5 | 5 | 8903 ± 501.37 |
| CPD-ELD | PTD4-KALA | 10 | 5 | 1 | 190 287 ± 9445 |
|  |  |  |  | 2 | 386 480 ± 17 229 |
|  |  |  |  | 5 | 241 230 ± 14 229 |
| ELD-CPD | EB1-PTD4 | 10 | 5 | 1 | 178 000 ± 11 934 |
|  |  |  |  | 2 | 277 476 ± 25 319 |
|  |  |  |  | 5 | 376 555 ± 16 075 |
| His-ELD-CPD-His | His-CM18-PTD4-His | 10 | 5 | 1 | 204 338 ± 22 673 |
|  |  |  |  | 2 | 307 329 ± 19 618 |
|  |  |  |  | 5 | 619 964 ± 17 411 |

The shuttle agent CM18-PTD4 was used as a model to demonstrate the modular nature of the individual protein domains, as well as their ability to be modified. More particularly, the presence or absence of: an N-terminal cysteine residue ("Cys"); different flexible linkers between the ELD and CPD domains ("L1": GGS; "L2": GGSGGGS (SEQ ID NO: 10 243); and "L3": GGSGGGSGGGS (SEQ ID NO: 10 244)) and different lengths, positions, and variants to histidine-rich domains; were studied.

HeLa cells were cultured and tested in the protein transduction assays using Protocol B as described in Example 9.1. Briefly, GFP-NLS recombinant protein (5 μM; see Example 5.1) was co-incubated with 20 μM of different shuttle peptide variants (see Table 1.3 for amino acid sequences and properties) of the shuttle agent His-CM18-PTD4 for 1 minute. After the final washing step, the cells were subjected to flow cytometry analysis as described in Example 3.3. Results are shown in Table 10.3e and FIG. 29I. "Pos cells (%)" is the mean percentages of all cells that emanate a GFP signal. The negative control ("Ctrl") corresponds to cells that were incubated with GFP-NLS recombinant protein (5 μM) without any shuttle agent.

TABLE 10.3e

Data from FIG. 29I

| Domain structure | Shuttle agent | Conc. of shuttle (μM) | Conc. of GFP-NLS (μM) | Mean % cells with GFP signal (±St Dev.; n = 3) | Cell viability (%) (±St. Dev.; n = 3) |
|---|---|---|---|---|---|
| — | No shuttle ("Ctrl") | 0 | 5 | 0 | 99.6 ± 0.12 |
| ELD-CPD | CM18-PTD4 |  |  | 47.6 ± 2.6 | 33.9 ± 3.7 |
|  | Cys-CM18-PTD4 |  |  | 36.6 ± 2.3 | 78.7 ± 3.1 |
|  | CM18-L1-PTD4 | 20 | 5 | 48.5 ± 3.0 | 50.1 ± 3.8 |
|  | CM18-L2-PTD4 |  |  | 45.5 ± 6.5 | 64.0 ± 1.3 |
|  | CM18-L3-PTD4 |  |  | 39.0 ± 2.7 | 71.9 ± 6.0 |
| His-ELD-CPD | His-CM18-PTD4 | 20 | 5 | 60.3 ± 3.2 | 81.6 ± 4.5 |
|  | His-CM18-PTD4-6Cys |  |  | 41.3 ± 4.28 | 62 ± 5.76 |
|  | Met-His-CM18-PTD4-Cys |  |  | 45.6 ± 3.88 | 54.9 ± 3.45 |
|  | 3His-CM18-PTD4 |  |  | 39.4 ± 0.5 | 39.2 ± 3.3 |
|  | 12His-CM18-PTD4 |  |  | 36.9 ± 4.3 | 33.4 ± 4.3 |
|  | HA-CM18-PTD4 |  |  | 42.3 ± 4.2 | 68.3 ± 4.1 |
|  | 3HA-CM18-PTD4 |  |  | 37.2 ± 3.9 | 43.6 ± 2.8 |
| ELD-His-CPD | CM18-His-PTD4 | 20 | 5 | 61.7 ± 1.8 | 57.7 ± 4.2 |
| His-ELD-CPD-His | His-CM18-PTD4-His | 20 | 5 | 68.0 ± 6.0 | 78.6 ± 1.1 |

These results show that variations in a given shuttle (e.g., CM18-PTD4) may be used to modulate the degree of transduction efficiency and cell viability of the given shuttle. More particularly, the addition of an N-terminal cysteine residue to CM18-PTD4 (see Cys-CM18-PTD4), decreased GFP-NLS transduction efficiency by 11% (from 47.6% to 36.6%), but increased cell viability from 33.9% to 78.7%. Introduction of flexible linker domains (L1, L2, and L3) of different lengths between the CM18 and PTD4 domains did not result in a dramatic loss of transduction efficiency, but increased cell viability (see CM18-L1-PTD4, CM18-L2-PTD4, and CM18-L3-PTD4). Finally, variations to the amino acid sequences and/or positions of the histidine-rich domain(s) did not result in a complete loss of transduction efficiency and cell viability of His-CM18-PTD4 (see 3His-CM18-PTD4, 12His-CM18-PTD4, HA-CM18-PTD4, 3HA-CM18-PTD4, CM18-His-PTD4, and His-CM18-PTD4-His). Of note, adding a second histidine-rich domain at the C terminus of His-CM18-PTD4 (i.e., His-CM18-PTD4-His) increased transduction efficiency from 60% to 68% with similar cell viability.

10.5 Lack of GFP-NLS Transduction by Single-Domain Peptides or a His-CPD Peptide in HeLa Cells: Flow Cytometry HeLa cells were cultured and tested in the protein transduction assays using Protocol B as described in Example 9.1. Briefly, GFP-NLS recombinant protein (5 μM; see Example 5.1) was co-incubated with 50 μM of different single-domain peptides (TAT; PTD4; Penetratin; CM18; C(LLKK)$_3$C; KALA) or the two-domain peptide His-PTD4 (lacking an ELD), and exposed to the HeLa cells for 10 seconds. After the final washing step, the cells were subjected to flow cytometry analysis as described in Example 3.3. Results are shown in Table 10.4 and FIG. 29D. "Pos cells (%)" is the mean percentages of all cells that emanate a GFP signal. The negative control ("Ctrl") corresponds to cells that were incubated with GFP-NLS recombinant protein (5 μM) without any single-domain peptide or shuttle agent.

described in Example 9.1. The cells were visualized by microscopy as described in Example 3.2, after an incubation time of 2 minutes.

Figures 30A, 30B, 30C, 30D, 30E, 30F:
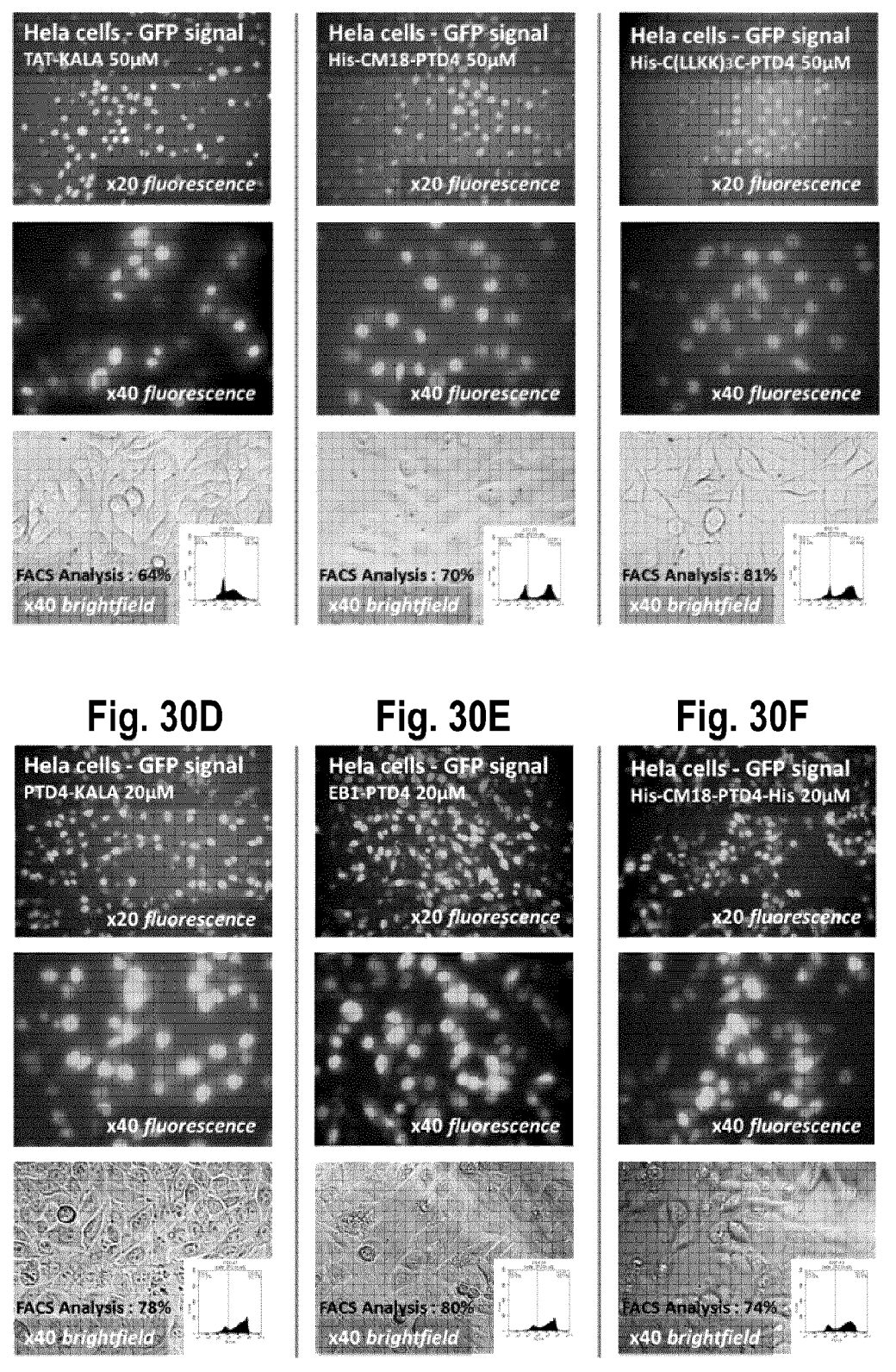

For the sample results shown in FIG. 30, GFP fluorescence of the HeLa cells was immediately visualized by bright field (bottom row panels) and fluorescence (upper and middle row panels) microscopy at 20× or 40× magnifications after the final washing step. The results with the shuttle agents TAT-KALA, His-CM18-PTD4, and His-C(LLKK)$_3$C-PTD4 are shown in FIGS. 30A, 30B and 30C, respectively. The results with the shuttle agents PTD4-KALA, EB1-PTD4, and His-CM18-PTD4-His are shown in FIGS. 30D, 30E and 30F, respectively. The insets in the bottom row panels show the results of corresponding FACS analyses (performed as described in Example 3.3), which indicates the percentage of cells in a 96-plate well with a GFP signal. No significant cellular GFP fluorescence was observed in negative control samples (i.e., cells exposed to GFP-NLS without any shuttle agent; data not shown).

10.7 GFP-NLS Transduction by TAT-KALA, His-CM18-PTD4 and His-C(LLKK)$_3$C-PTD4 with Varying Incubation Times in THP-1 Cells: Flow Cytometry THP-1 cells were cultured and tested in the protein transduction assays using Protocol C as described in Example 9.1. Briefly, GFP-NLS recombinant protein (5 μM; see Example 5.1) was co-incubated with 1 μM of TAT-

TABLE 10.4

Data from FIG. 29D

| Protocol | Domain | Single-domain peptide | Cells | Conc. of shuttle (μM) | Conc. of GFP-NLS (μM) | Mean % cells with GFP signal (± St. Dev.; n = 3) | Cell viability (%) (± St. Dev.; n = 3) |
|---|---|---|---|---|---|---|---|
| B | — | No peptide ("Ctrl") | HeLa | 0 | 5 | 0.1 ± 0.02 | 98.3 ± 0.59 |
|   | CPD | TAT | HeLa | 50 | 5 | 1.1 ± 0.27 | 94.6 ± 0.44 |
|   |   | PTD4 |   |   |   | 1.1 ± 0.06 | 94 ± 4.5 |
|   |   | Penetratin (Pen) |   |   |   | 3.6 ± 0.1 | 96 ± 0.6 |
|   | ELD | CM18 | HeLa | 50 | 5 | 2.9 ± 0.2 | 95 ± 1.2 |
|   |   | C(LLKK)$_3$C |   |   |   | 1.1 ± 0.57 | 61.8 ± 0.1 |
|   |   | KALA |   |   |   | 1.4 ± 0.13 | 84 ± 0.7 |
|   | His-CPD | His-PTD4 | HeLa | 50 | 5 | 1.04 ± 0.12 | 96.5 ± 0.28 |

These results show that the single-domain peptides TAT, PTD4, Penetratin, CM18, C(LLKK)$_3$C, KALA, or the two-domain peptide His-PTD4 (lacking an ELD), are not able to successfully transduce GFP-NLS in HeLa cells.

10.6 GFP-NLS Transduction by TAT-KALA, His-CM18-PTD4, His-C(LLKK)$_3$C-PTD4, PTD4-KALA, EB1-PTD4, and His-CM18-PTD4-His in HeLa Cells: Visualization by Microscopy GFP-NLS recombinant protein (5 μM; see Example 5.1) was co-incubated with 50 μM of shuttle agent, and then exposed to HeLa cells for 10 seconds using Protocol B as KALA, His-CM18-PTD4, or His-C(LLKK)$_3$C-PTD4 for 15, 30, 60, or 120 seconds. After the final washing step, the cells were subjected to flow cytometry analysis as described in Example 3.3. The mean percentages of cells emanating a GFP signal ("Pos cells (%)") are shown in Table 10.4a and in FIG. 34A. The mean fluorescence intensity is shown in Table 10.5 and FIG. 34B. The negative control ("Ctrl") corresponds to cells that were incubated with GFP-NLS recombinant protein (5 μM) without any shuttle agent.

TABLE 10.4a

Figure 34A:
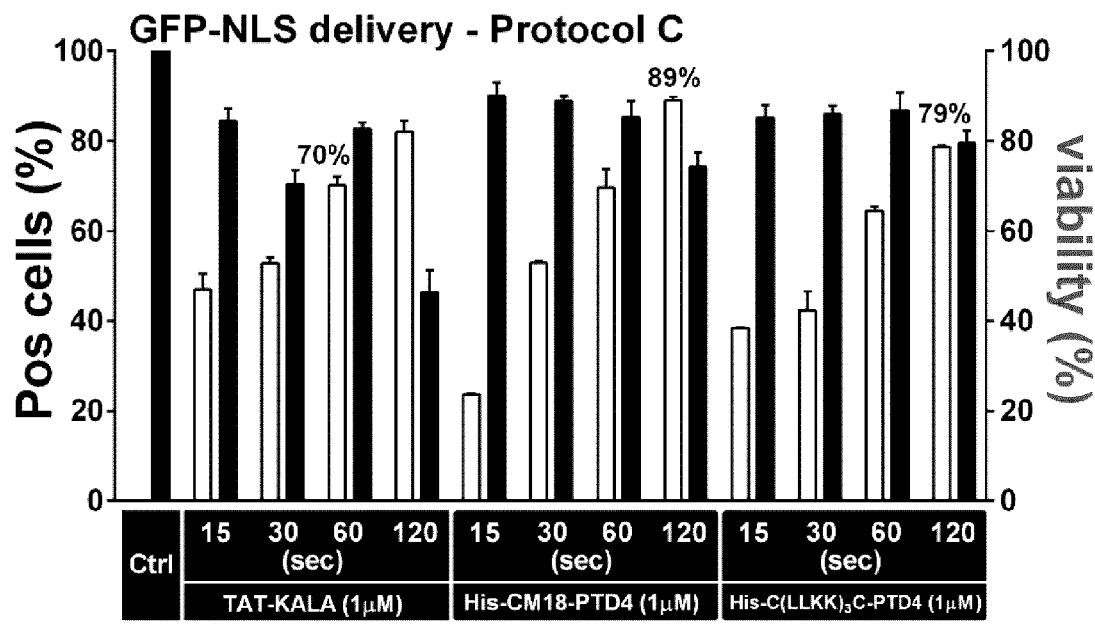
FIGS. 34A-34B show the results of GFP-NLS transduction efficiency experiments in THP-1 cells using the shuttle TAT-KALA, His-CM18-PTD4, or His-C(LLKK)$_3$C-PTD4. The cargo protein/shuttle agents were exposed to the THP-1 cells for 15, 30, 60 or 120 seconds. GFP-NLS transduction efficiency was evaluated by flow cytometry and the percentage of GFP fluorescent cells ("Pos cells (%)"), as well as corresponding cell viability data ("viability (%)") are shown in FIG. 34A.

Data from FIG. 34A

| Protocol | Shuttle agent | Cells | Conc. of shuttle (μM) | Conc. of GFP-NLS (μM) | Incubation time (sec.) | Mean % cells with GFP signal (±St. Dev.; n = 3) | Cell viability (%) (±St. Dev.; n = 3) |
|---|---|---|---|---|---|---|---|
| C | No shuttle ("Ctrl") | THP-1 | 0 | 5 | 120 | 1.12 ± 0.27 | 97.3 ± 1.55 |
| | TAT-KALA | THP-1 | 1 | 5 | 15 | 47 ± 3.5 | 84.6 ± 2.7 |
| | | | | | 30 | 52.9 ± 1.3 | 70.3 ± 3.2 |
| | | | | | 60 | 70.1 ± 2.0 | 82.7 ± 1.4 |
| | | | | | 120 | 82.1 ± 2.5 | 46.3 ± 4.9 |
| | His-CM18-PTD4 | THP-1 | 1 | 5 | 15 | 23.7 ± 0.2 | 90 ± 3.0 |
| | | | | | 30 | 53 ± 0.3 | 89 ± 1.1 |
| | | | | | 60 | 69.6 ± 4.2 | 85.3 ± 3.6 |
| | | | | | 120 | 89 ± 0.8 | 74.3 ± 3.2 |
| | His-C(LLKK)₃C-PTD4 | THP-1 | 1 | 5 | 15 | 38.4 ± 0.3 | 85.2 ± 2.8 |
| | | | | | 30 | 42.3 ± 4.2 | 86 ± 2.0 |
| | | | | | 60 | 64.5 ± 1.0 | 86.9 ± 3.8 |
| | | | | | 120 | 78.7 ± 0.3 | 79.6 ± 2.8 |

TABLE 10.5

Figure 34B:
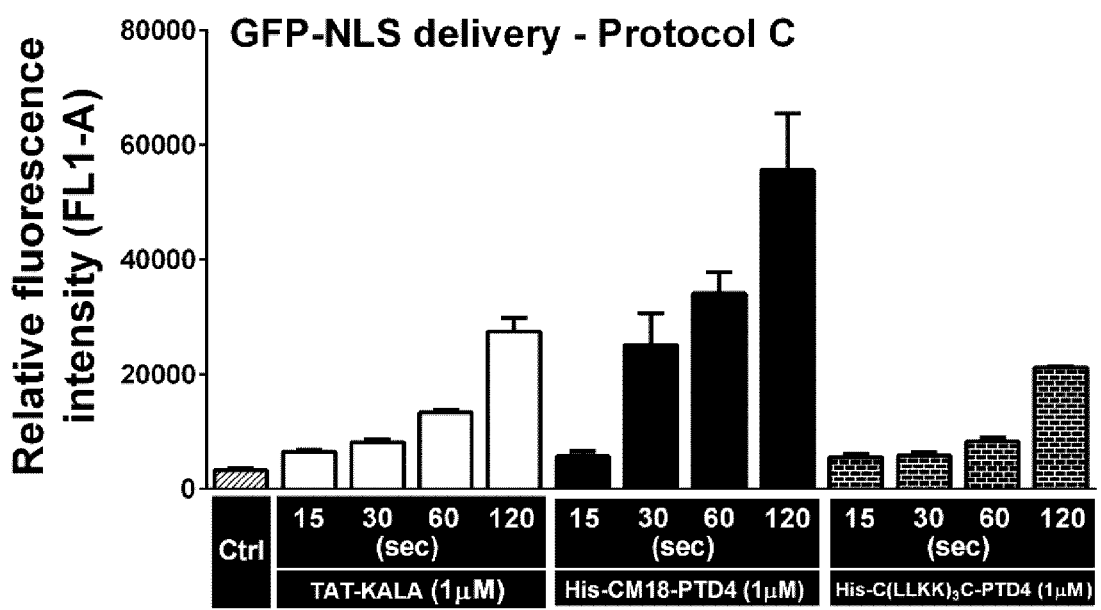

Data from FIG. 34B

| Protocol | Shuttle agent | Cells | Conc. of shuttle (μM) | Incubation time (sec.) | Relative fluorescence intensity (FL1-A) (n = 3) | Standard Deviation |
|---|---|---|---|---|---|---|
| C | No shuttle ("Ctrl") | THP-1 | 0 | 120 | 217 | 23.09 |
| | TAT-KALA | THP-1 | 1 | 15 | 6 455.12 | 333.48 |
| | | | | 30 | 8 106.81 | 436.28 |
| | | | | 60 | 13 286.2 | 463.96 |
| | | | | 120 | 27 464.92 | 2 366.48 |
| | His-CM18-PTD4 | THP-1 | 1 | 15 | 5 605.45 | 933.16 |
| | | | | 30 | 25 076.41 | 5 567.33 |
| | | | | 60 | 34 046.94 | 3 669.19 |
| | | | | 120 | 55 613.48 | 9 836.84 |
| | His-C(LLKK)₃C-PTD4 | THP-1 | 1 | 15 | 5 475.12 | 693.29 |
| | | | | 30 | 5 755.8 | 635.18 |
| | | | | 60 | 8 267.38 | 733.29 |
| | | | | 120 | 21 165.06 | 209.37 |

Example 11

Repeated Daily Treatments with Low Concentrations of Shuttle Agent in the Presence of Serum Results in GFP-NLS Transduction in THP-1 Cells 11.1 GFP-NLS Transduction with His-CM8-PTD4 or His-C(LLKK)3C-PTD4 in THP-1 Cells: Flow Cytometry THP-1 cells were cultured and tested in the protein transduction assay using Protocol A as described in Example 9.1, but with the following modifications. GFP-NLS recombinant protein (5, 2.5, or 1 μM; see Example 5.1) was co-incubated with 0.5 or 0.8 μM of His-CM18-PTD4, or with 0.8 μM of His-C(LLKK)₃C-PTD4, and then exposed to THP-1 cells each day for 150 min in the presence of cell culture medium containing serum. Cells were washed and subjected to flow cytometry analysis as described in Example 3.3 after 1 or 3 days of repeated exposure to the shuttle agent/cargo. The results are shown in Table 11.1 and in FIGS. 35A, 35B, 35C and 35F. The negative control ("Ctrl") corresponds to cells that were incubated with GFP-NLS recombinant protein (5 μM) without any shuttle agent.

TABLE 11.1

Data from FIG. 35A, 35B, 35C and 35F

| FIG. | Shuttle agent | Cells | Conc. of shuttle (μM) | Conc. of GFP-NLS (μM) | Exposure to shuttle/cargo (days) | Mean % cells with GFP signal (±St. Dev.; n = 3) | Cell viability (%) (±St. Dev.; n = 3) |
|---|---|---|---|---|---|---|---|
| 35A | No shuttle (Ctrl) | THP-1 | 0 | 5 | 0 | 0.15 ± 0.04 | 98.7 ± 0.1 |
| | His-CM18-PTD4 | | 0.5 | 5 | 1 | 12.1 ± 1.5 | 98.2 ± 2.4 |
| | | | | | 3 | 73.4 ± 1.1 | 84.3 ± 3.8 |
| 35B | No shuttle (Ctrl) | THP-1 | 0 | 5 | 0 | 0.36 ± 0.09 | 97.1 ± 1.2 |
| | His-CM18-PTD4 | | 0.8 | 2.5 | 1 | 12.2 ± 0.9 | 92.3 ± 1.9 |
| | | | | | 3 | 62.4 ± 3.5 | 68.5 ± 2.2 |
| 35C | No shuttle (Ctrl) | THP-1 | 0 | 5 | 0 | 0.28 ± 0.05 | 96.4 ± 2.0 |
| | His-CM18-PTD4 | | 0.8 | 1 | 1 | 1.6 ± 0.2 | 98.4 ± 6.4 |
| | | | | | 3 | 6.5 ± 0.9 | 80.6 ± 4.6 |
| 35F | No shuttle (Ctrl) | THP-1 | 0 | 5 | 0 | 0.62 ± 0.11 | 96.3 ± 1.4 |
| | His-C(LLKK)₃C-PTD4 | | 0.8 | 1 | 1 | 1.8 ± 0.2 | 97.2 ± 2.2 |
| | | | | | 3 | 6.6 ± 0.8 | 76.6 ± 3.4 |

The viability of THP-1 cells repeatedly exposed to His-CM18-PTD4 and GFP-NLS was determined as described in Example 3.3a. The results are shown in Tables 11.2 and 11.3 and in FIGS. 35D and 35E. The results in Table 11.2 and FIG. 35D show the metabolic activity index of the THP-1 cells after 1, 2, 4, and 24 h, and the results in Table 11.3 and FIG. 35E show the metabolic activity index of the THP-1 cells after 1 to 4 days.

TABLE 11.2

Figure 35A:
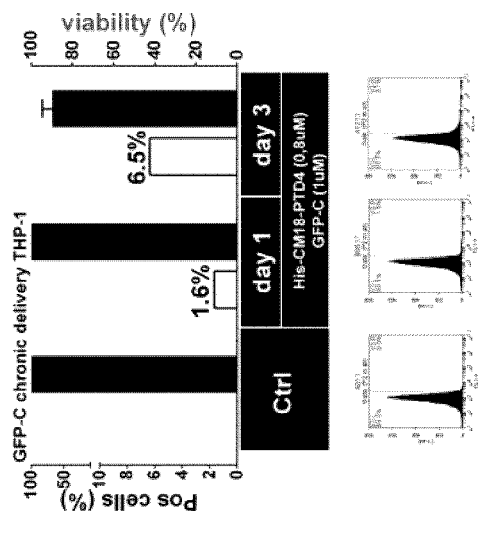
FIG. 35A-35F shows the results of transduction efficiency experiments in which THP-1 cells were exposed daily to GFP-NLS cargo in the presence of a shuttle agent for 2.5 hours. His-CM18-PTD4 was used in FIGS. 35A-35E, and His-C(LLKK)$_3$C-PTD4 was used in FIG. 35F. GFP-NLS transduction efficiency was determined by flow cytometry at Day 1 or Day 3, and the results are expressed as the percentage of GFP fluorescent cells ("Pos cells (%)"), as well as corresponding cell viability data ("viability (%)") in FIGS. 35A-35C and 35F.
Figure 35B:
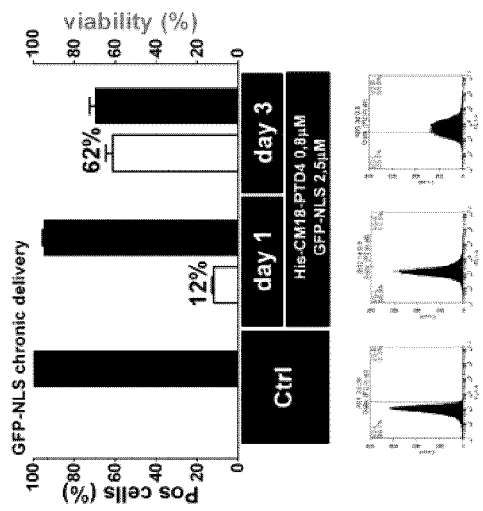
Figure 35C:
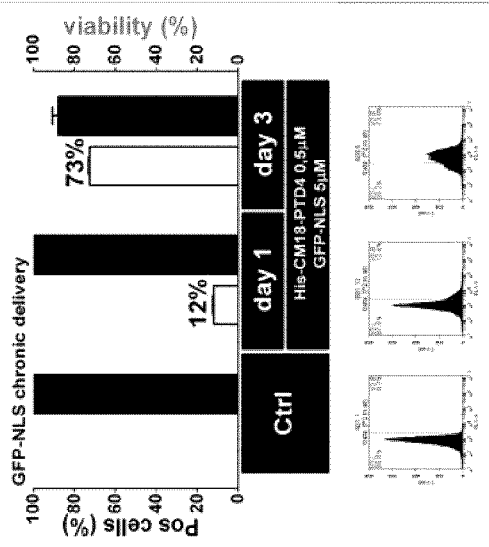
Figure 35D:
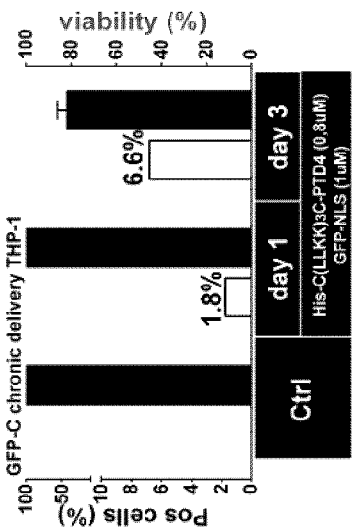
Figure 35E:
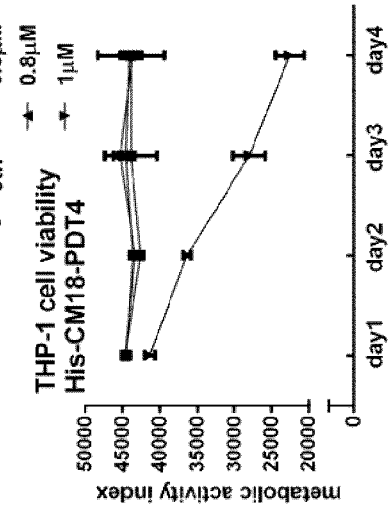
Figure 35F:
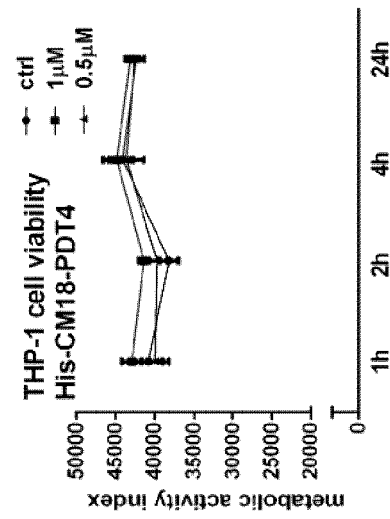

Data from FIG. 35D

| Shuttle agent | Cells | Conc. of shuttle (µM) | Conc. of GFP-NLS (µM) | Mean metabolic activity index (±St. Dev.; n = 3) (Exposure to shuttle/cargo) | | | |
|---|---|---|---|---|---|---|---|
| | | | | 1 h | 2 h | 4 h | 24 h |
| No shuttle (Ctrl) | THP-1 | 0 | 5 | 40810 ± 757.39 | 38223 ± 238.66 | 44058 ± 320.23 | 42362 ± 333.80 |
| His-CM18-PTD4 | THP-1 | 0.5 | 5 | 9974 ± 1749.85 | 9707 ± 1259.82 | 3619 ± 2247.54 | 2559 ± 528.50 |
| | | 1 | 5 | 42915 ± 259.67 | 41386 ± 670.66 | 44806 ± 824.71 | 43112 ± 634.56 |

TABLE 11.3

Data from FIG. 35E

| Shuttle agent | Cells | Conc. of shuttle (µM) | Conc. of GFF-NLS (µM) | Mean metabolic activity index (±St. Dev.; n = 3) (Exposure to shuttle/cargo) | | | |
|---|---|---|---|---|---|---|---|
| | | | | 1 day | 2 days | 3 days | 4 days |
| No shuttle (Ctrl) | THP-1 | 0 | 5 | 44684 ± 283.27 | 43389 ± 642,47 | 45312 ± 963.40 | 43697 ± 1233 |
| | | 0.5 | 5 | 44665 ± 310.3 | 42664 ± 398.46 | 43927 ± 3511.54 | 43919 ± 4452.25 |
| His-CM184FTD4 | THP-1 | 0.8 | 5 | 44531 ± 176.66 | 43667 ± 421.66 | 44586 ± 383.68 | 44122 ± 239.98 |
| | | 1 | 5 | 41386 ± 670.66 | 36422 ± 495.01 | 27965 ± 165.33 | 22564 ± 931.28 |

The results in Example 11 show that repeated daily (or chronic) treatments with relatively low concentrations of His-CM18-PTD4 or His-C(LLKK)$_3$C-PTD4 in the presence of serum result in intracellular delivery of GFP-NLS in THP-1 cells. The results also suggest that the dosages of the shuttle agents and the cargo can be independently adjusted to improve cargo transduction efficiency and/or cell viability.

Example 12

His-CM18-PTD4 Increases Transduction Efficiency and Nuclear Delivery of GFP-NLS in a Plurality of Cell Lines 12.1 GFP-NLS Transduction with His-CM18-PTD4 in Different Adherent & Suspension Cells: Flow Cytometry The ability of the shuttle agent His-CM18-PTD4 to deliver GFP-NLS to the nuclei of different adherent and suspension cells using Protocols B (adherent cells) or C (suspension cells) as described in Example 9.1 was examined. The cell lines tested included: HeLa, Balb3T3, HEK 293T, CHO, NIH3T3, Myoblasts, Jurkat, THP-1, CA46, and HT2 cells, which were cultured as described in Example 1. GFP-NLS (5 µM; see Example 5.1) was co-incubated with 35 µM of His-CM18-PTD4 and exposed to adherent cells for 10 seconds (Protocol B), or was co-incubated with 5 µM of His-CM18-PTD4 and exposed to suspension cells for 15 seconds (Protocol C). Cells were washed and subjected to flow cytometry analysis as described in Example 3.3. Results are shown in Table 12.1 and FIG. 36. "Pos cells (%)" is the mean percentages of all cells that emanate a GFP signal.

TABLE 12.1

Data from FIG. 36

| Shuttle agent | Protocol | Conc. of shuttle (µM) | Conc. of GFP-NLS (µM) | Cells | Mean % cells with GFP signal (±St. Dev.; n = 3) | Cell viability (%) (±St. Dev.; n = 3) |
|---|---|---|---|---|---|---|
| His-CM18-PTD4 | B | 35 | 5 | HeLa | 72.3 ± 5.3 | 94.6 ± 0.4 |
| | | | | Balb3T3 | 40.2 ± 3.1 | 98.4 ± 0.6 |

TABLE 12.1-continued

Data from FIG. 36

| Shuttle agent | Protocol | Conc. of shuttle (μM) | Conc. of GFP-NLS (μM) | Cells | Mean % cells with GFP signal (±St. Dev.; n = 3) | Cell viability (%) (±St. Dev.; n = 3) |
|---|---|---|---|---|---|---|
| | | | | HEK 293T | 55.3 ± 0.2 | 95.3 ± 1.2 |
| | | | | CHO | 53.7 ± 4.6 | 92.8 ± 0.1 |
| | | | | NIH3T3 | 35.4 ± 3.9 | 3.3 ± 5.4 |
| | | | | Myoblasts | 25.6 ± 2.6 | 23.5 ± 1.1 |
| | C | 5 | 5 | Jurkat | 30.7 ± 2.2 | 73.6 ± 0.7 |
| | | | | THP-1 | 64.1 ± 1.6 | 64.1 ± 4.5 |
| | | | | CA46 | 24.4 ± 0.6 | 71.6 ± 1.0 |
| | | | | HT2 | 30.5 ± 2.5 | 90.6 ± 1.5 |

TABLE 12.1

Data from FIG. 36

| Shuttle agent | Protocol | Conc. of shuttle (μM) | Conc. of GFP-NLS (μM) | Cells | Mean % cells with GFP signal (±St. Dev.; n = 3) | Cell viability (%) (±St. Dev.; n = 3) |
|---|---|---|---|---|---|---|
| His-CM18-PTD4 | B | 35 | 5 | HeLa | 72.3 ± 5.3 | 94.6 ± 0.4 |
| | | | | Balb3T3 | 40.2 ± 3.1 | 98.4 ± 0.6 |
| | | | | HEK 293T | 55.3 ± 0.2 | 95.3 ± 1.2 |
| | | | | CHO | 53.7 ± 4.6 | 92.8 ± 0.1 |
| | | | | NIH3T3 | 35.4 ± 3.9 | 3.3 ± 5.4 |
| | | | | Myoblasts | 25.6 ± 2.6 | 23.5 ± 1.1 |
| | C | 5 | 5 | Jurkat | 30.7 ± 2.2 | 73.6 ± 0.7 |
| | | | | THP-1 | 64.1 ± 1.6 | 64.1 ± 4.5 |
| | | | | CA46 | 24.4 ± 0.6 | 71.6 ± 1.0 |
| | | | | HT2 | 30.5 ± 2.5 | 90.6 ± 1.5 |

12.2 GFP-NLS Transduction with His-CM18-PTD4 in Several Adherent and Suspension Cells: Visualization by Microscopy GFP-NLS recombinant protein (5 μM; see Example 5.1) was co-incubated with 35 μM of His-CM18-PTD4 and exposed to adherent cells for 10 seconds using Protocol A, or was co-incubated with 5 μM of His-CM18-PTD4 and exposed to suspension cells for 15 seconds using Protocol B, as described in Example 9.1. After washing the cells, GFP fluorescence was visualized by bright field and fluorescence microscopy. Sample images captured at 10×magnifications showing GFP fluorescence are shown for 293T (FIG. 37A), Balb3T3 (FIG. 37B), CHO (FIG. 37C), Myoblasts (FIG. 370), Jurkat (FIG. 37E), CA46 (FIG. 37F), HT2 (FIG. 37G), and NIH3T3 (FIG. 37H) cells. The insets show corresponding flow cytometry results performed as described in Example 3.3, indicating the percentage of GFP-NLS-positive cells. No significant cellular GFP fluorescence was observed in negative control samples (i.e., cells exposed to GFP-NLS without any shuttle agent; data not shown).

Figure 38A:
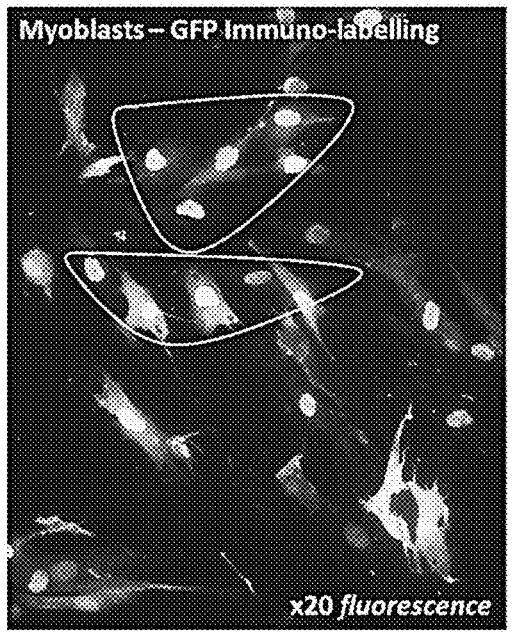
FIGS. 38A-38B show fluorescence microscopy images of primary human myoblasts transduced with GFP-NLS using the shuttle His-CM18-PTD4. Cells were fixed and permeabilized prior to immuno-labelling GFP-NLS with an anti-GFP antibody and a fluorescent secondary antibody. Immuno-labelled GFP is shown in FIG. 38A, and this image is overlaid with nuclei (DAPI) labelling in FIG. 38B.
Figure 38B:
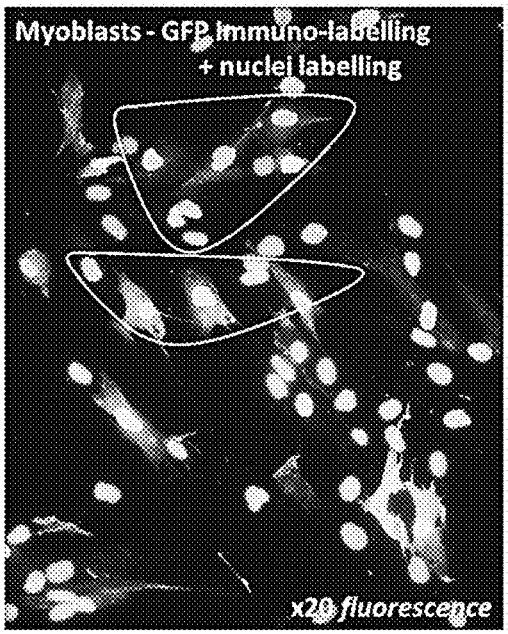

Nuclear localization of the GFP-NLS was further confirmed in fixed and permeabilized myoblasts using cell immuno-labelling as described in Example 3.2a. GFP-NLS was labeled using a primary mouse monoclonal anti-GFP antibody (Feldan, #A017) and a secondary goat anti-mouse Alexa™-594 antibody (Abcam #150116). Nuclei were labelled with DAPI. Sample results for primary human myoblast cells are shown in FIG. 38, in which GFP immuno-labelling is shown in FIG. 38A, and an overlay of the GFP immuno-labelling and DAPI labelling is shown in FIG. 38B. No significant cellular GFP labelling was observed in negative control samples (i.e., cells exposed to GFP-NLS without any shuttle agent; data not shown).

The microscopy results revealed that GFP-NLS is successfully delivered to the nucleus of all the tested cells using the shuttle agent His-CM18-PTD4.

Example 13

His-CM18-PTD4 Enables Transduction of a CRISPR/Cas9-NLS System and Genome Editing in Hela Cells 13.1 Cas9-NLS Recombinant Protein Cas9-NLS recombinant protein was constructed, expressed and purified from a bacterial expression system as described in Example 1.4. The sequence of the Cas9-NLS recombinant protein produced was:

[SEQ ID NO: 74]
MDKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSN

FDLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGN

SRFAWMTRKSEETITPWNFEEVVDKGASAQSFIERMTNFDKNLPNEKVLPK

-continued

```
HSLLYEYFTVYNELTKVKYVTEGMRKPAFLSGEQKKAIVDLLFKTNRKVTV

KQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLS

RKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMAR

ENQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGKS

DNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRK

MIAKSEQEIGKATAKYFFYSNIMNFFKTEITLANGEIRKRPLIETNGETGE

IVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSS

FEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKY

FDTTIDRKRYTSTKEVLDATLIHQSITGLYETRIDLSQLGGDGGRSSDDEA

TADSQHAAPPKKKRKVGGSGGGSGGGSGGGRHHHHHH
(MW = 162.9 kDa; pI = 9.05)
NLS sequence is underlined
Serine/glycine rich linkers are in bold
```

13.2 Transfection Plasmid Surrogate Assay

Figure 39A:
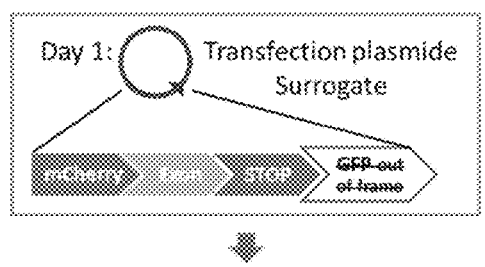
FIG. 39A-39E show a schematic layout (FIGS. 39A, 39B and 39C) and sample fluorescence images (FIGS. 39D and 39E) of a transfection plasmid surrogate assay used to evaluate the activity of intracellularly delivered CRISPR/Cas9-NLS complex. At Day 1 (FIG. 39A), cells are transfected with an expression plasmid encoding the fluorescent proteins mCherry™ and GFP, with a STOP codon separating their two open reading frames. Transfection of the cells with the expression plasmid results in only mCherry™ expression (FIG. 39D). A CRISPR/Cas9-NLS complex, which has been designed/programmed to cleave the plasmid DNA at the STOP codon, is then delivered intracellularly to the transfected cells expressing mCherry™, resulting double-stranded cleavage of the plasmid DNA at the STOP codon (FIG. 39B). In a fraction of the cells, random non-homologous DNA repair of the cleaved plasmid occurs and results in removal of the STOP codon (FIG. 39C), and thus GFP expression and fluorescence (FIG. 39E). White triangle windows indicate examples of areas of co-labelling of mCherry™ and GFP fluorescence.
Figure 39B:
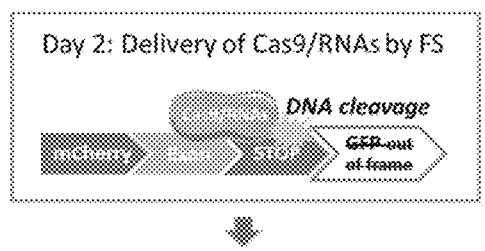
Figure 39C:
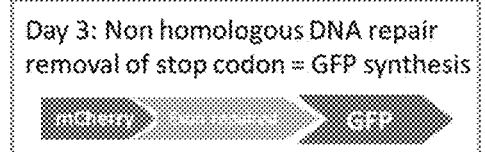
Figure 39D:
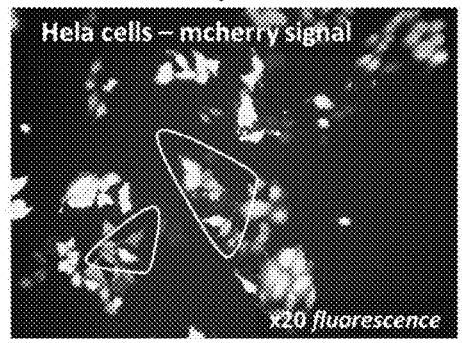
Figure 39E:
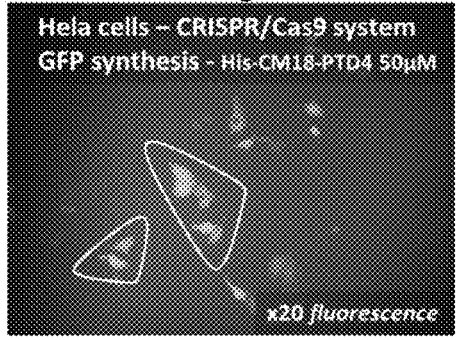

This assay enables one to visually identify cells that have been successfully delivered an active CRISPR/Cas9 complex. As shown in FIG. 39A, the assay involves transfecting cells with an expression plasmid DNA encoding the fluorescent proteins mCherry™ and GFP, with a STOP codon separating their two open reading frames. Transfection of the cells with the expression plasmid results in mCherry™ expression, but no GFP expression (FIG. 39B). A CRISPR/Cas9 complex, which has been designed/programmed to cleave the plasmid DNA at the STOP codon, is then delivered intracellularly to the transfected cells expressing mCherry™ (FIG. 39D). Successful transduction of an active CRISPR/Cas9 complex results in the CRISPR/Cas9 complex cleaving the plasmid DNA at the STOP codon (FIG. 39C). In a fraction of the cells, random non-homologous DNA repair of the cleaved plasmid occurs and results in removal of the STOP codon, and thus GFP expression and fluorescence (FIG. 39E).

On Day 1 of the transfection plasmid surrogate assay, DNA plasmids for different experimental conditions (250 ng) are diluted in DMEM (50 µL) in separate sterile 1.5-mL tubes, vortexed and briefly centrifuged. In separate sterile 1.5-mL tubes, Fastfect™ transfection reagent was diluted in DMEM (50 µL) with no serum and no antibiotics at a ratio of 3:1 (3 µL of Fastfect™ transfection reagent for 1 µg of DNA) and then quickly vortexed and briefly centrifuged. The Fastfect™/DMEM mixture was then added to the DNA mix and quickly vortexed and briefly centrifuged. The Fastfect™/DMEM/DNA mixture is then incubated for 15-20 min at room temperature, before being added to the cells (100 µL per well). The cells are then incubated at 37° C. and 5% $CO_2$ for 5 h. The media is then changed for complete medium (with serum) and further incubated at 37° C. and 5% $CO_2$ for 24-48 h. The cells are then visualized under fluorescent microscopy to view the mCherry™ signal.

13.3 His-CM18-PTD4-Mediated CRISPR/Cas9-NLS System Delivery and Cleavage of Plasmid DNA RNAs (crRNA & tracrRNA) were designed to target a nucleotide sequence of the EMX1 gene, containing a STOP codon between the mCherry™ and GFP coding sequences in the plasmid of Example 13.2. The sequences of the crRNA and tracrRNA used were as follows:

```
crRNA [SEQ ID NO: 75]:
5'-GAGUCCGAGCAGAAGAAGAAGUUUUAGAGCUAUGCUGUUUUG-3' tracrRNA [SEQ ID NO: 76]:
5'-AAACAGCAUAGCAAGUUAAAAUAAGGCUAGUCCGUUAUCAACUUGAAA

AAGUGGCACCGAGUCGGUGCU-3'
```

HeLa cells were cultured and subjected to the transfection plasmid surrogate assay as described in Example 13.2). On Day 1, the HeLa cells were transfected with a plasmid surrogate encoding the mCherry™ protein as shown in FIG. 39A. On Day 2, a mix of Cas9-NLS recombinant protein (2 µM; see Example 13.1) and RNAs (crRNA & tracrRNA; 2 µM; see above) were co-incubated with 50 µM of His-CM18-PTD4, and the mixture (CRISPR/Cas9 complex) was exposed to HeLa cells for 10 seconds using Protocol B as described in Example 9.1. Double-stranded plasmid DNA cleavage by the CRISPR/Cas9 complex at the STOP codon between the mCherry™ and GFP coding sequences (FIG. 39B), and subsequent non-homologous repair by the cell in some cases results in removal of the STOP codon (FIG. 39C), thereby allowing expression of both the mCherry™ and GFP fluorescent proteins in the same cell on Day 3 (FIG. 39D-39E). White triangle windows in FIGS. 39D and 39E indicate examples of areas of co-labelling between mCherry™ and GFP.

As a positive control for the CRISPR/Cas9-NLS system, HeLa cells were cultured and co-transfected with three plasmids: the plasmid surrogate (as described in Example 13.2) and other expression plasmids encoding the Cas9-NLS protein (Example 13.1) and the crRNA/tracrRNAs (Example 13.3). Typical fluorescence microscopy results are shown in FIGS. 40A-D. Panels A and B show cells 24 hours post-transfection, while panels C and D show cells 72 hours post-transfection.

Figure 40A:
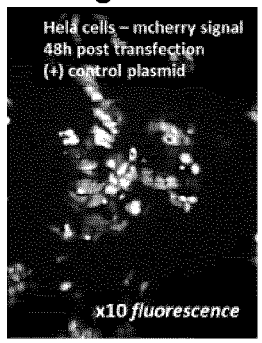
FIG. 40A-40H show fluorescence microscopy images of HeLa cells expressing mCherry™ and GFP, indicating CRISPR/Cas9-NLS-mediated cleavage of plasmid surrogate DNA. In panels A-D, HeLa cells were co-transfected with three plasmids: the plasmid surrogate as described in the brief description of FIGS. 39A-39E, and two other expression plasmids encoding the Cas9-NLS protein and crRNA/tracrRNAs, respectively. CRISPR/Cas9-mediated cleavage of the plasmid surrogate at the STOP codon, and subsequent DNA repair by the cell, enables expression of GFP (FIGS. 40B and 40D) in addition to mCherry™ (FIGS. 40A and 40C).
Figure 40B:
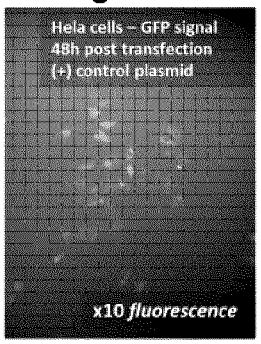
Figure 40C:
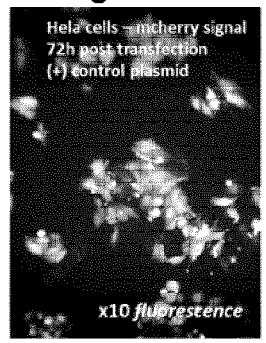
Figure 40D:
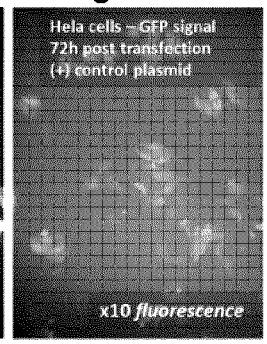
Figure 40E:
Figure 40F:
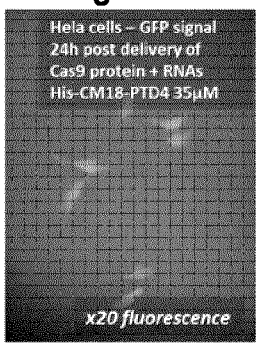
Figure 40G:
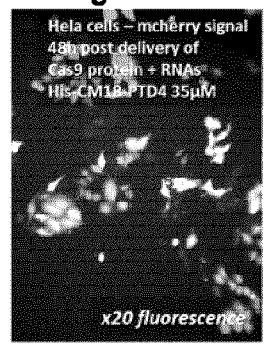
Figure 40H:

FIG. 40E-40H shows the results of a parallel transfection plasmid surrogate assay performed using 35 µM of the shuttle His-CM18-PTD4, as described for FIG. 39. FIGS. 40E and 40F show cells 24 hours post-transduction, while panels G and H show cells 48 hours post-transduction. FIGS. 40E and 40G show mCherry™ fluorescence, and FIGS. 40F and 40H show GFP fluorescence, the latter resulting from removal of the STOP codon by the transduced CRISPR/Cas9-NLS complex and subsequent non-homologous repair by the cell. No significant cellular GFP fluorescence was observed in negative control samples (i.e., cells exposed to CRISPR/Cas9-NLS complex without any shuttle agent; data not shown).

13.4 T7E1 Assay

The T7 endonuclease I (T7E1) can be used to detect on-target CRISPR/Cas genome editing events in cultured cells. As an overview, genomic DNA from target cells is amplified by PCR. The PCR products are then denatured and reannealed to allow heteroduplex formation between wild-type DNA and CRISPR/Cas-mutated DNA. T7E1, which recognizes and cleaves mismatched DNA, is used to digest the heteroduplexes. The resulting cleaved and full-length PCR products are visualized by gel electrophoresis.

The T7E1 assay was performed with the Edit-R™ Synthetic crRNA Positive Controls (Dharmacon #U-007000-05) and the T7 Endonuclease I (NEB, Cat #M0302S). After the delivery of the CRISPR/Cas complex, cells were lysed in 100 µL of Phusion™ High-Fidelity DNA polymerase (NEB #M0530S) laboratory with additives. The cells were incubated for 15-30 minutes at 56° C., followed by deactivation for 5 minutes at 96° C. The plate was briefly centrifuged to collect the liquid at bottom of the wells. 50-µL PCR samples were set up for each sample to be analyzed. The PCR samples were heated to 95° C. for 10 minutes and then slowly (>15 minutes) cooled to room temperature. PCR product (~5 µL) was then separated on an agarose gel (2%) to confirm amplification. 15 µL of each reaction was incubated with T7E1 nuclease for 25 minutes at 37° C. Immediately, the entire reaction volume was run with the appropriate gel loading buffer on an agarose gel (2%).

13.5 His-CM18-PTD4 and His-C(LLKK)$_3$C-PTD4-Mediated CRISPR/Cas9-NLS System Delivery and Cleavage of Genomic PPIB Sequence A mix composed of a Cas9-NLS recombinant protein (25 nM; Example 13.1) and crRNA/tracrRNA (50 nM; see below) targeting a nucleotide sequence of the PPIB gene were co-incubated with 10 µM of His-CM18-PTD4 or His-C(LLKK)$_3$C-PTD4, and incubated with HeLa cells for 16 h in medium without serum using Protocol A as described in Example 9.1.

The sequences of the crRNA and tracrRNAs constructed and their targets were:

```
Feldan tracrRNA [SEQ ID NO: 77]:
5'-AAACAGCAUAGCAAGUUAAAAUAAGGCUAGUCCGUUAUCAACUUGAAA

AAGUGGCACCGAGUCGGUGCU-3'

PPIB crRNA [SEQ ID NO: 78]:
5'-GUGUAUUUUGACCUACGAAUGUUUUAGAGCUAUGCUGUUUUG-3'

Dharmacon tracrRNA [SEQ ID NO: 79]:
5'-AACAGCAUAGCAAGUUAAAAUAAGGCUAGUCCGUUAUCAACUUGAAAA

AGUGGCACCGAGUCGGUGCUUUUUUU-3'
```

After 16 h, HeLa cells were washed with PBS and incubated in medium with serum for 48 h. HeLa cells were harvested to proceed with the T7E1 protocol assay as described in Example 13.4.

Figure 41A:
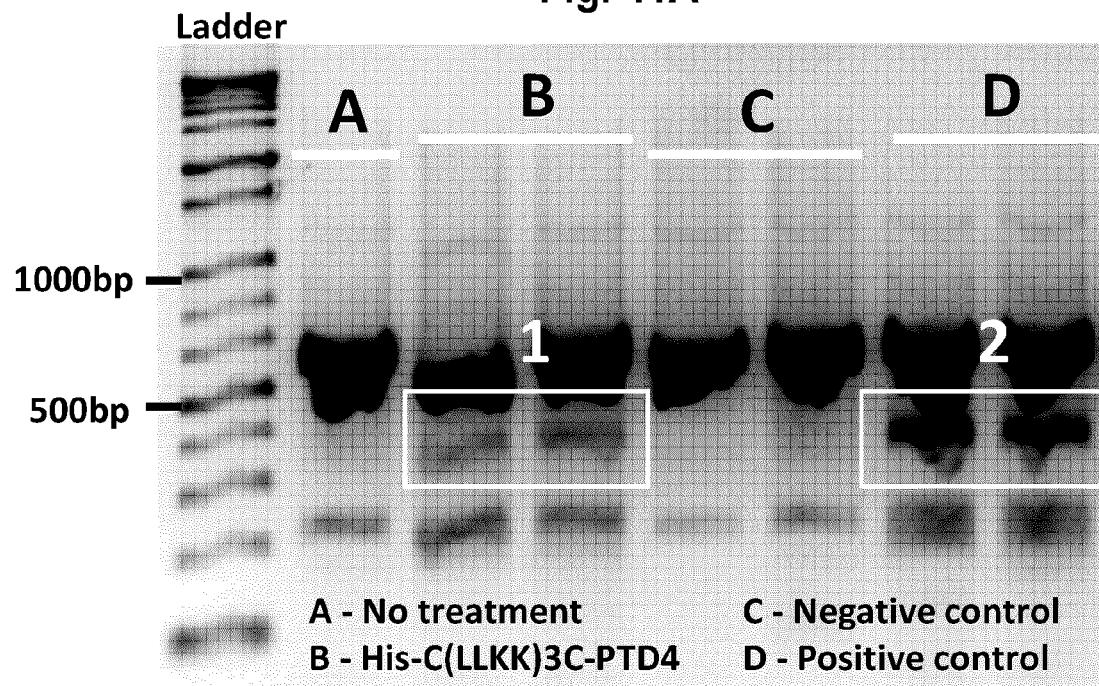
FIG. 41A (lanes A to D) shows the products of a DNA cleavage assay (T7E1 assay) separated by agarose gel electrophoresis, which is used to measure CRISPR/Cas9-mediated cleavage of cellular genomic DNA. HeLa cells were transduced with a CRISPR-Cas9-NLS complex programmed to cleave the PPIB gene. The presence of the cleavage product framed in white boxes 1 and 2, indicates cleavage of the PPIB gene by the CRISPR-Cas9-NLS complex, which was delivered intracellularly using the shuttle His-C(LLKK)$_3$C-PTD4 (FIG. 41A, lane B) or with a lipidic transfection agent used as a positive control (FIG. 41A, lane D). This cleavage product is absent in negative controls (FIG. 41A, lanes A and C).

FIG. 41A shows an agarose gel with the PPIB DNA sequences after PCR amplification. Lane A shows the amplified PPIB DNA sequence in HeLa cells without any treatment (i.e., no shuttle or Cas9/RNAs complex). Lanes B: The two bands framed in white box #1 are the cleavage product of the PPIB DNA sequence by the CRIPR/Cas9 complex after the delivery of the complex with the shuttle His-C (LLKK)$_3$C-PTD4. Lane C: These bands show the amplified PPIB DNA sequence after incubation of the HeLa cells with the Cas9/RNAs complex without shuttle (negative control). Lane D: The bands framed in white box #2 show the amplified PPIB DNA sequence after incubation of the HeLa cells with the Cas9/RNAs complex in presence of a lipidic transfection agent (DharmaFect™ transfection reagent #T-20XX-01) (positive control). Similar results were obtained using the shuttle His-CM18-PTD4 (data not shown).

Figure 41B:
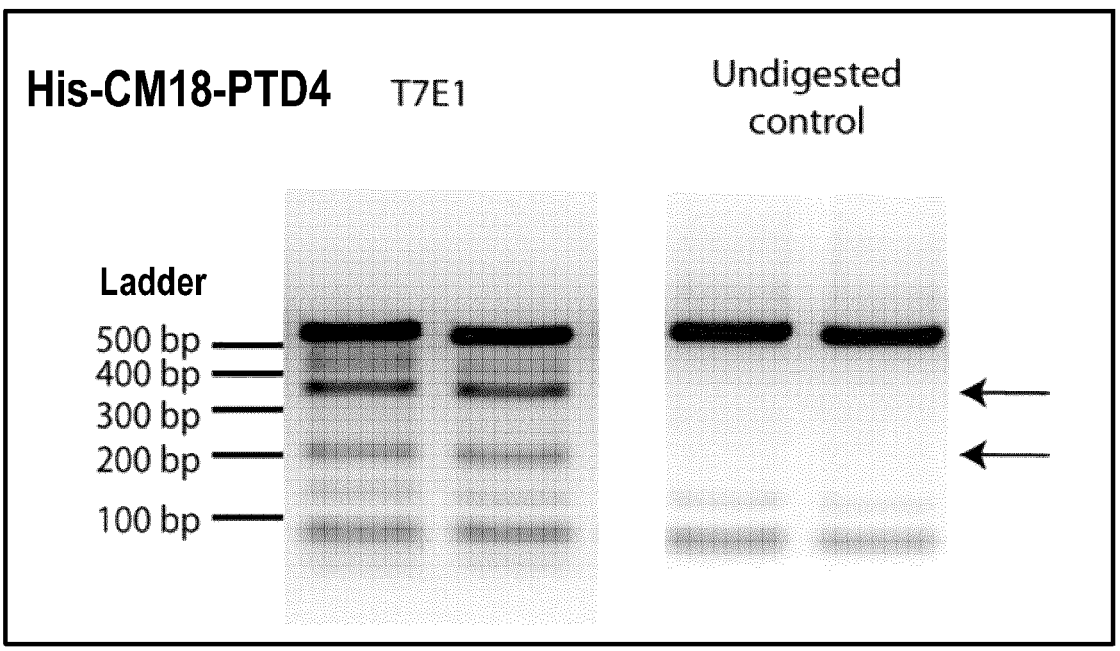
FIG. 41B shows the products of a DNA cleavage assay (T7E1 assay) separated by agarose gel electrophoresis, which is used to measure CRISPR/Cas9-mediated cleavage of cellular genomic DNA (PPIB DNA sequences). The left panel shows the cleavage product of the amplified PPIB DNA sequence by the CRIPR/Cas9 complex after the delivery of the complex with the shuttle agent His-CM18-PTD4 in HeLa cells. The right panel shows amplified DNA sequence before the T7E1 digestion procedure as a negative control.

FIG. 41B shows an agarose gel with the PPIB DNA sequences after PCR amplification. The left panel shows the cleavage product of the amplified PPIB DNA sequence by the CRIPR/Cas9 complex after the delivery of the complex with the shuttle agent His-CM18-PTD4 in HeLa cells. The right panel shows amplified DNA sequence before the T7E1 digestion procedure as a negative control.

Figure 41C:
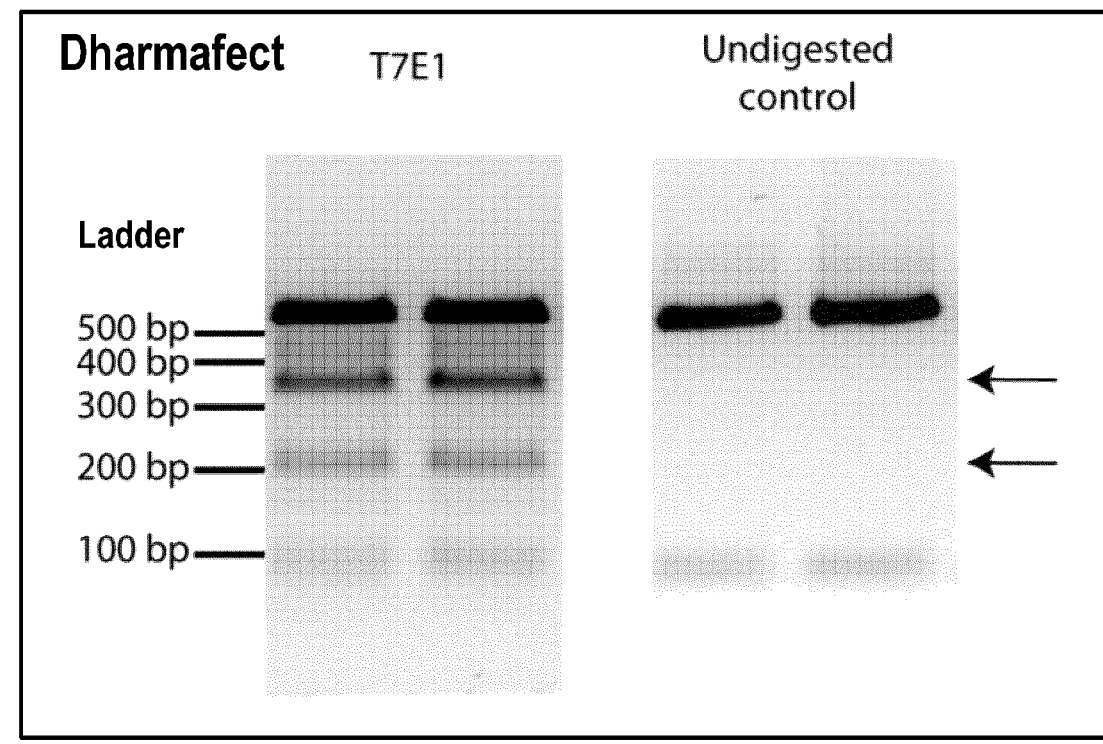
FIG. 41C shows the products of a DNA cleavage assay (T7E1 assay) separated by agarose gel electrophoresis, which is used to measure CRISPR/Cas9-mediated cleavage of cellular genomic DNA (PPIB DNA sequences). The left panel shows the amplified PPIB DNA sequence after incubation of the HeLa cells with the Cas9/RNAs complex in presence of a lipidic transfection agent (DharmaFect™ transfection reagent #T-20XX-01) (positive control). The right panel shows amplified DNA sequence before the T7E1 digestion procedure as a negative control.

FIG. 41C shows an agarose gel with the PPIB DNA sequences after PCR amplification. The left panel shows the amplified PPIB DNA sequence after incubation of the HeLa cells with the Cas9/RNAs complex in presence of a lipidic transfection agent (DharmaFect™ transfection reagent #T-20XX-01) (positive control). The right panel shows amplified DNA sequence before the T7E1 digestion procedure as a negative control.

These results show that the shuttle agents His-CM18-PTD4 and His-C(LLKK)$_3$C-PTD4 successfully deliver a functional CRISPR/Cas9 complex to the nucleus of HeLa cells, and that this delivery results in CRISPR/Cas9-mediated cleavage of genomic DNA.

13.6 CRISPR/Cas9-NLS System Delivery by Different Shuttle Agents, and Cleavage of Genomic HPTR Sequence in HeLa and Jurkat Cells A mix composed of a Cas9-NLS recombinant protein (2.5 µM; Example 13.1) and crRNA/tracrRNA (2 µM; see below) targeting a nucleotide sequence of the HPTR gene were co-incubated with 35 µM of His-CM18-PTD4, His-CM18-PTD4-His, His-C(LLKK)3C-PTD4, or EB1-PTD4, and incubated with HeLa or Jurkat cells for 2 minutes in PBS using Protocol B as described in Example 9.1.

The sequences of the crRNA and tracrRNAs constructed and their targets were:

```
Feldan tracrRNA [SEQ ID NO: 77]:
5'-
AAACAGCAUAGCAAGUUAAAAUAAGGCUAGUCCGUUAUCAACUUGAAAAA

GUGGCACCGAGUCGGUGCU-3'

HPRT crRNA [SEQ ID NO: 103]:
5'-AAUUAUGGGGAUUACUAGGAGUUUUAGAGCUAUGCU-3'
```

Figure 46A:
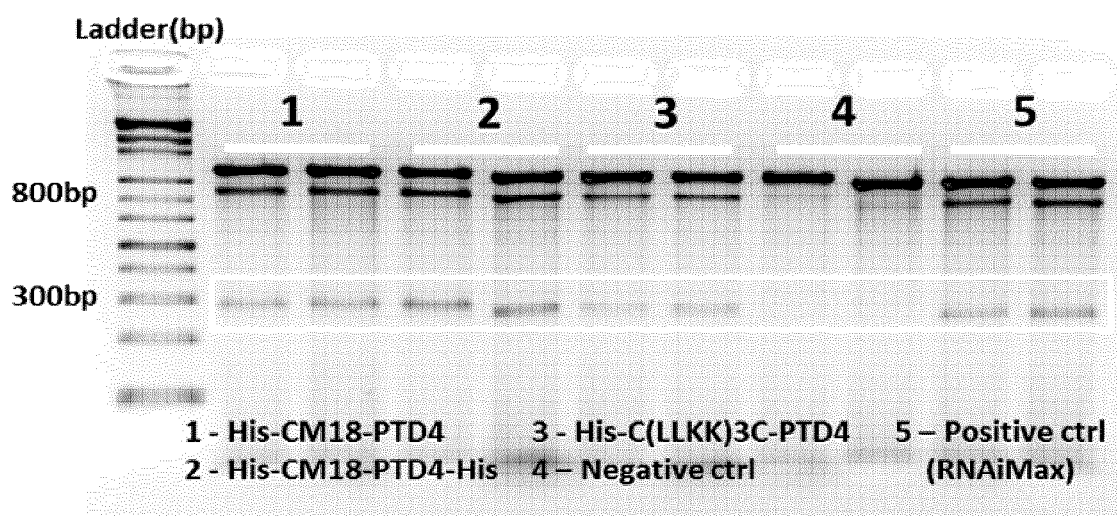
FIGS. 46A and 46B show the products of a DNA cleavage assay separated by agarose gel electrophoresis, which is used to measure CRISPR/Cas9-mediated cleavage of cellular genomic DNA (HPTR sequence) after intracellular delivery of the complex with different shuttle agents.
Figure 46B:
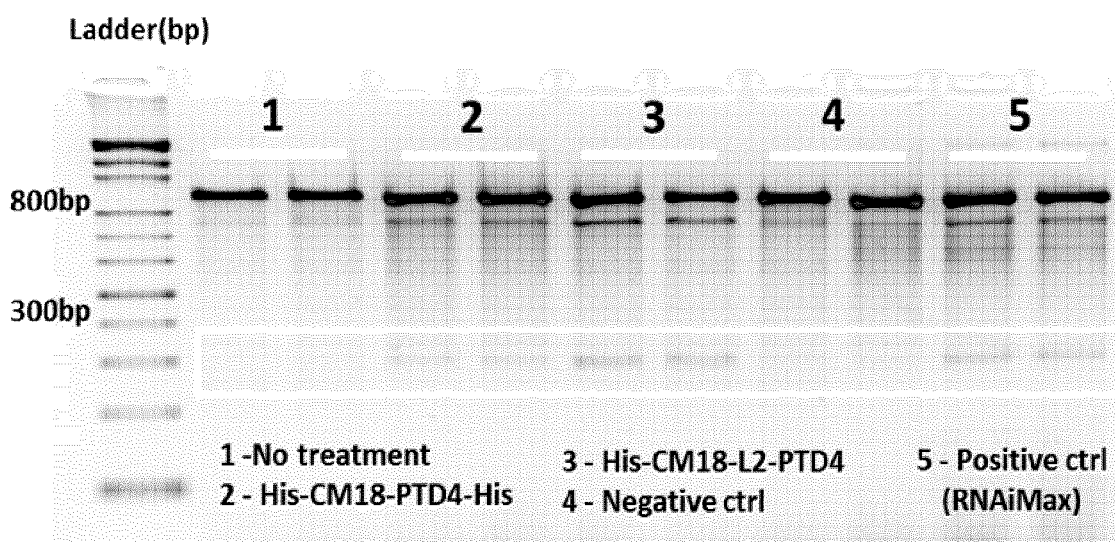

After 2 minutes, cells were washed with PBS and incubated in medium with serum for 48 h. Cells were harvested to proceed with the T7E1 protocol assay as described in Example 13.4. FIG. 46 shows an agarose gel with the HPTR DNA sequences after PCR amplification and the cleavage product of the amplified HPTR DNA sequence by the CRISPR/Cas9 complex after the delivery of the complex with the different shuttle agents. FIG. 46A shows the results with the shuttle agents: His-CM18-PTD4, His-CM18-PTD4-His, and His-C(LLKK)3C-PTD4 in HeLa cells. FIG. 46B shows the results with His-CM18-PTD4 and His-CM18-L2-PTD4 in Jurkat cells. Negative controls (lanes 4) show amplified HPTR DNA sequence after incubation of the cells with the CRISPR/Cas9 complex without the presence of the shuttle agent. Positive controls (lane 5 in FIGS. 46A and 46B) show the amplified HPTR DNA sequence after incubation of the cells with the Cas9/RNAs complex in presence of a lipidic transfection agent (Lipofectamine® RNAiMAX™ Transfection Reagent ThermoFisher Product No. 13778100).

These results show that different polypeptide shuttle agents of the present description may successfully deliver a functional CRISPR/Cas9 complex to the nucleus of HeLa and Jurkat cells, and that this delivery results in CRISPR/Cas9-mediated cleavage of genomic DNA.

Example 14

His-CM18-PTD4 Enables Transduction of the Transcription Factor HOXB4 in THP-1 Cells

14.1 HOXB4-WT Recombinant Protein

Human HOXB4 recombinant protein was constructed, expressed and purified from a bacterial expression system as described in Example 1.4. The sequence of the HOXB4-WT recombinant protein produced was:

[SEQ ID NO: 80]
MHHHHHHMAMSSFLINSNYVDPKFPPCEEYSQSDYLPSDHSPGYYAGGQR

RESSFQPEAGFGRRAACTVQRYPPPPPPPPPGLSPRAPAPPPAGALLPE

PGQRCEAVSSSPPPPPCAQNPLHPSPSHSACKEPVVYPWMRKVHVSTVNP

NYAGGEPKRSRTAYTRQQVLELEKEFHYNRYLTRRRRVEIAHALCLSERQ

IKIWFQNRRMKWKKDHKLPNTKIRSGGAAGSAGGPPGRPNGGPRAL (MW = 28.54 kDa; pI = 9.89)

The initiator methionine and the 6x Histidine tag are shown in bold.

14.2 Real-Time Polymerase Chain Reaction (rt-PCR)

Control and treated cells are transferred to separate sterile 1.5-mL tubes and centrifuged for 5 minutes at 300 g. The cell pellets are resuspended in appropriate buffer to lyse the cells. RNAase-free 70% ethanol is then added followed by mixing by pipetting. The lysates are transferred to an RNeasy™ Mini spin column and centrifuged 30 seconds at 13000 RPM. After several washes with appropriate buffers and centrifugation steps, the eluates are collected in sterile 1.5-mL tubes on ice, and the RNA quantity in each tube is then quantified with a spectrophotometer. For DNase treatment, 2 µg of RNA is diluted in 15 µL of RNase-free water. 1.75 µL of 10×DNase buffer and 0.75 µL of DNase is then added, followed by incubation at 37° C. for 15 minutes. For reverse transcriptase treatment, 0.88 µL of EDTA (50 nM) is added, followed by incubation at 75° C. for 5 minutes. In a PCR tube, 0.5 µg of DNase-treated RNA is mixed with 4 µL of iScript™ Reverse transcription Supermix (5×) and 20 µL of nuclease-free water. The mix is incubated in a PCR machine with the following program: 5 min at 25° C., 30 min at 42° C. and 5 min at 85° C. Newly synthesized cDNA is transferred in sterile 1.5-mL tubes and diluted in 2 µL of nuclease-free water. 18 µL per well of a qPCR machine (CFX-96™) mix is then added in a PCR plate for analysis.

14.3 HOXB4-WT Transduction by His-CM18-PTD4 in THP-1 Cells: Dose Responses and Viability THP-1 cells were cultured and tested in the protein transduction assay using Protocol A as described in Example 9.1. Briefly, THP-1 cells were plated at 30 000 cells/well one day before transduction. HOXB4-WT recombinant protein (0.3, 0.9, or 1.5 µM; Example 14.1) was co-incubated with different concentrations of His-CM18-PTD4 (0, 0.5, 7.5, 0.8 or 1 µM) and then exposed to THP-1 cells for 2.5 hours in the presence of serum. The cells were subjected to real time-PCR analysis as described in Example 14.2 to measure the mRNA levels of a target gene as a marker for HOXB4 activity, which was then normalized to the target gene mRNA levels detected in the negative control cells (no treatment), to obtain a "Fold over control" value. Total RNA levels (ng/µL) were also measured as a marker for cell viability. Results are shown in Table 14.1 and FIG. 42.

TABLE 14.1

Figure 42:
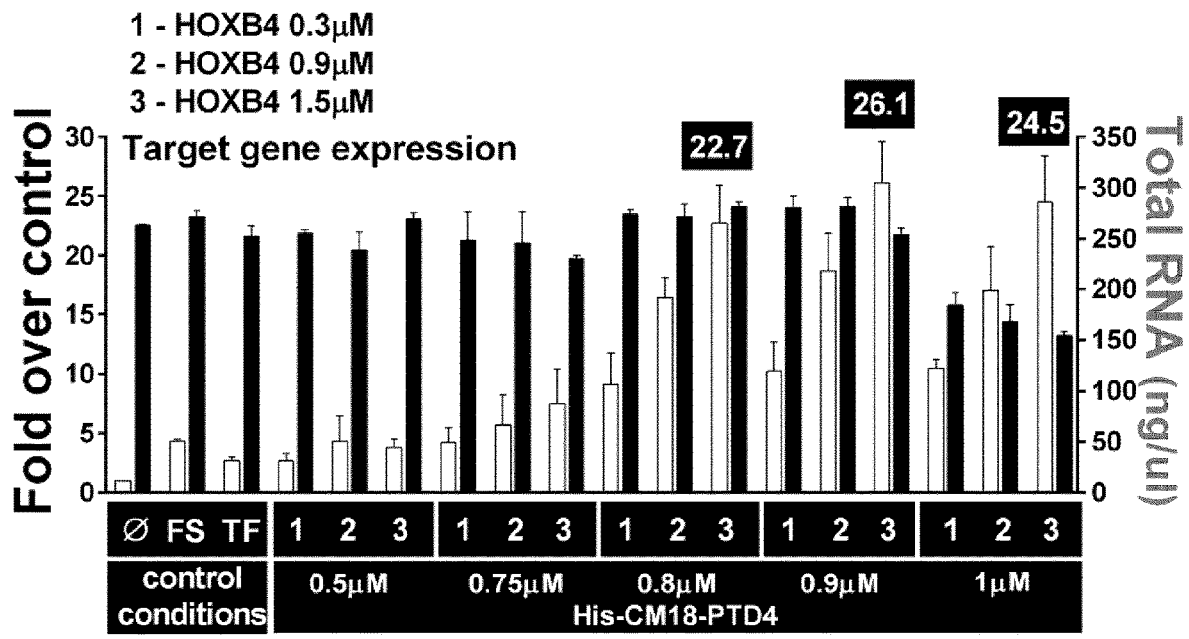
FIGS. 42-44 show the transcriptional activity of THP-1 cells that have been transduced with the transcription factor HOXB4 using different concentrations of the shuttle His-CM18-PTD4 and different cargo/shuttle exposure times. Successful intra-nuclear delivery of HOXB4 was determined by monitoring mRNA levels of a target gene by real-time PCR, and the results are normalized against those in the negative control (HOXB4 without shuttle agent) and expressed as "Fold over control" (left bars). Total cellular RNA (ng/µL) was quantified and used a marker for cell viability (right bars). "0" or "Ctrl" means "no treatment"; "TF" means "Transcription Factor alone"; "FS" means "shuttle alone".

Data from FIG. 42

| Cargo/ shuttle agent (FIG. 41) | Cells | Conc. of shuttle (µM) | Conc. of HOXB4-WT (µM) | Fold over control (mean ± St. Dev) | Total RNA in ng/µL (mean ± St. Dev) |
|---|---|---|---|---|---|
| No treatment ("Ø") | THP-1 | 0 | 0 | 1 ± 0.1 | 263 ± 0.4 |
| HOXB4-WT alone ("TF") | THP-1 | 0 | 1.5 | 4.3 ± 0.1 | 271 ± 6.0 |
| His-CM18-PTD4 alone ("FS") | THP-1 | 1 | 0 | 2.7 ± 0.3 | 252 ± 10.7 |
| His-CM18-PTD4 + HOXB4-WT | THP-1 | 0.5 | 0.3 | 2.7 ± 0.6 | 255 ± 3.9 |
| | | | 0.9 | 4.3 ± 2.1 | 239 ± 17.5 |
| | | | 1.5 | 3.8 ± 0.7 | 269 ± 6.4 |
| His-CM18-PTD4 + HOXB4-WT | THP-1 | 0.75 | 0.3 | 4.2 ± 1.2 | 248 ± 28 |
| | | | 0.9 | 5.7 ± 2.5 | 245 ± 31 |
| | | | 1.5 | 7.5 ± 2.8 | 230 ± 3.3 |
| His-CM18-PTD4 + HOXB4-WT | THP-1 | 0.8 | 0.3 | 9.1 ± 2.7 | 274 ± 4.4 |
| | | | 0.9 | 16.4 ± 1.7 | 272 ± 12.5 |
| | | | 1.5 | 22.7 ± 3.2 | 282 ± 4.7 |
| His-CM18-PTD4 + HOXB4-WT | THP-1 | 0.9 | 0.3 | 10.2 ± 2.5 | 280 ± 11.3 |
| | | | 0.9 | 18.7 ± 3.1 | 281 ± 9.2 |
| | | | 1.5 | 26.1 ± 3.5 | 253 ± 7.1 |
| His-CM18-PTD4 + HOXB4-WT | THP-1 | 1 | 0.3 | 10.5 ± 0.7 | 184 ± 12.3 |
| | | | 0.9 | 17 ± 3.7 | 168 ± 16.2 |
| | | | 1.5 | 24.5 ± 3.9 | 154 ± 4.7 |

These results show that exposing THP-1 cells to a mixture of the shuttle agent His-CM18-PTD4 and the transcription factor HOXB4-WT for 2.5 hours in the presence of serum results in a dose-dependent increase in mRNA transcription of the target gene. These results suggest that HOXB4-WT is successfully delivered in an active form to the nucleus of THP-1 cells, where it can mediate transcriptional activation.

14.4 HOXB4-WT Transduction by His-CM8-PTD4 in THP-1 Cells: Time Course and Viability (0 to 48 Hours)

THP-1 cells were cultured and tested in the protein transduction assay using Protocol A as described in Example 9.1. Briefly, THP-1 cells were plated at 30 000 cells/well one day before the first time course experiment. HOXB4-WT recombinant protein (1.5 µM; Example 14.1) was co-incubated with His-CM18-PTD4 (0.8 µM) and then exposed to THP-1 cells for 0, 2.5, 4, 24 or 48 hours in presence of serum. The cells were subjected to real time-PCR analysis as described in Example 14.2 to measure mRNA levels of a target gene as a marker for HOXB4 activity, which was then normalized to the target gene mRNA levels detected in the negative control cells (no treatment), to obtain a "Fold over control" value. Total RNA levels (ng/µL) were also measured as a marker for cell viability. Results are shown in Table 14.2 and FIG. 43.

TABLE 14.2

Figure 43:
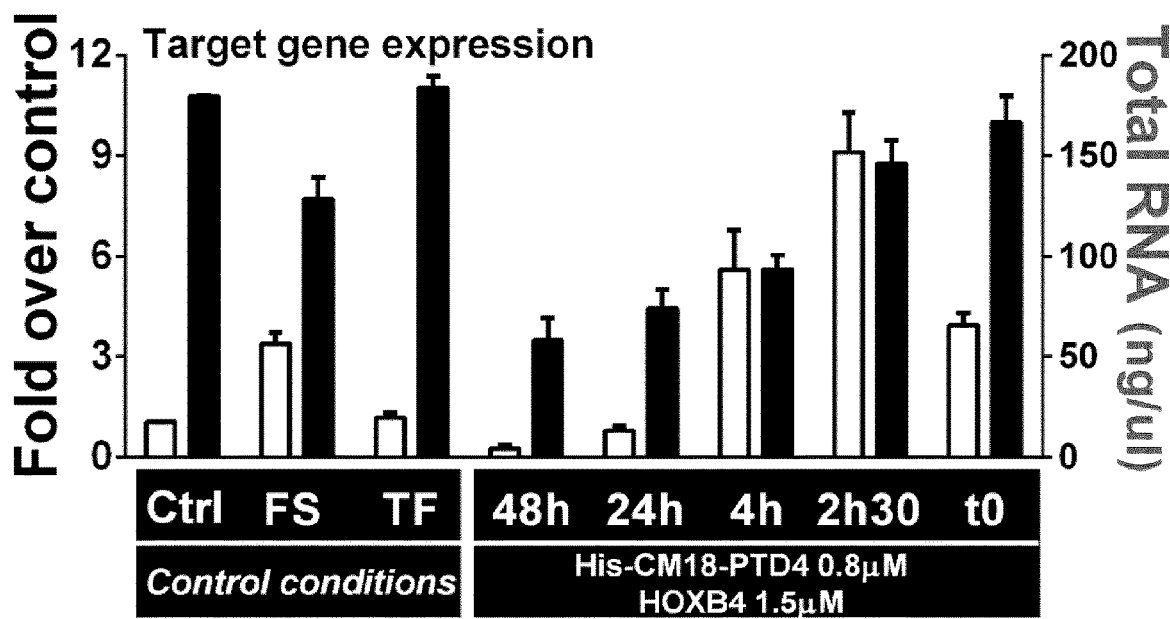

Data from FIG. 43

| Cargo/shuttle agent (FIG. 43) | Cells | Conc. of shuttle (µM) | Conc. of HOXB4-WT (µM) | Exposure time (hours) | Fold over control (mean ± St. Dev) | Total RNA in ng/µL (mean ± St. Dev) |
|---|---|---|---|---|---|---|
| No treatment ("Ctrl") | THP-1 | 0 | 0 | — | 1 ± 0.1 | 180 ± 0.4 |
| HOXB4-WT alone ("TF") | THP-1 | 0 | 1.5 | 2.5 h | 3.4 ± 0.3 | 129 ± 10.7 |
| His-CM18-PTD4 alone ("FS") | THP-1 | 0.8 | 0 | 2.5 h | 1.2 ± 0.14 | 184 ± 6.0 |
| His-CM18-PTD4 + HOXBA-WT | THP-1 | 0.8 | 1.5 | 48 h | 0.27 ± 0.1 | 58 ± 11.2 |
| | | | | 24 h | 0.8 ± 0.14 | 74 ± 9.2 |
| | | | | 4 h | 5.6 ± 1.2 | 94 ± 7.1 |
| | | | | 2.5 h | 9.1 ± 1.2 | 146 ± 11.6 |
| | | | | 0 | 3.9 ± 0.4 | 167 ± 13 |

14.5 HOXB4-WT Transduction by His-CM18-PTD4 in THP-1 Cells: Time Course and Viability (0 to 4 Hours)

THP-1 cells were cultured and tested in the protein transduction assay using Protocol A as described in Example 9.1. Briefly, THP-1 cells were plated at 30 000 cells/well one day before the first time course experiment. HOXB4-WT recombinant protein (0.3 µM; Example 14.1) was co-incubated with His-CM18-PTD4 (0.8 µM) and then exposed to THP-1 cells for 0, 0.5, 1, 2, 2.5, 3 or 4 hours in presence of serum. The cells were subjected to real time-PCR analysis as described in Example 14.2 to measure mRNA levels of a target gene as a marker for HOXB4 activity, which was then normalized to target gene mRNA levels detected in the negative control cells (no treatment), to obtain a "Fold over control" value. Total RNA levels (ng/µL) were also measured as a marker for cell viability. Results are shown in Table 14.3 and FIG. 44.

TABLE 14.3

Figure 44:
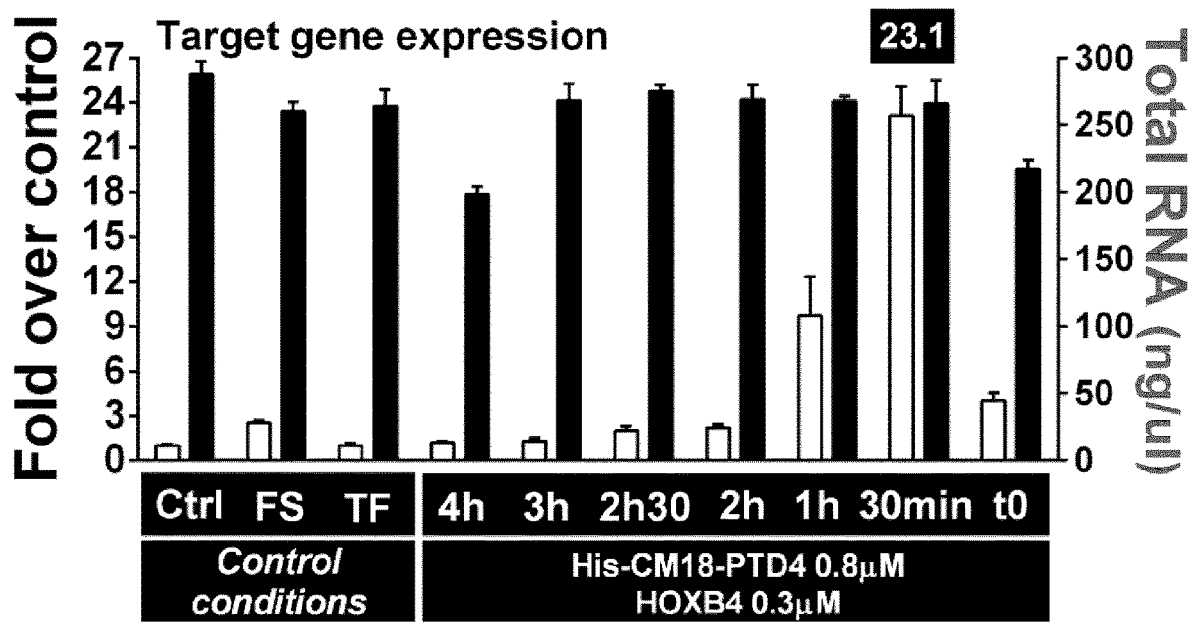
Figure 45A:
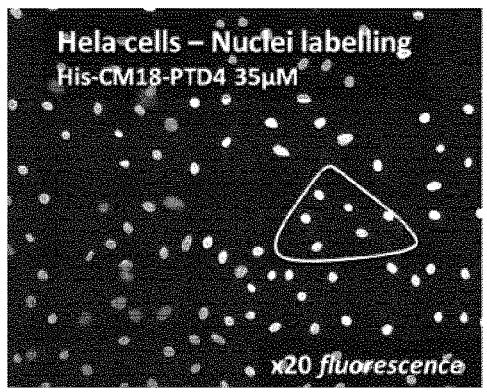
FIGS. 45A-45D show fluorescence microscopy images of HeLa cells transduced with wild-type HOXB4 cargo using the shuttle His-CM18-PTD4. After a 30-minute incubation to allow transduced HOXB4-WT to accumulate in the nucleus, the cells were fixed, permeabilized and HOXB4-WT was labelled using a primary anti-HOXB4 monoclonal antibody and a fluorescent secondary antibody (FIGS. 45B and 45D). Nuclei were labelled with DAPI (FIGS. 45A and 45C). White triangle windows indicate examples of areas of co-labelling between nuclei and HOXB4—compare FIG. 45A vs 45B (×20 magnification), and FIG. 45C vs 45D (×40 magnification).
Figure 45B:
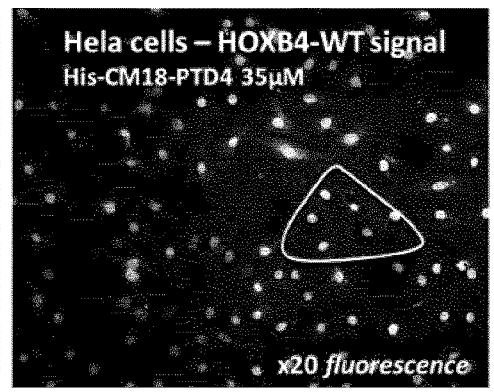
Figure 45C:
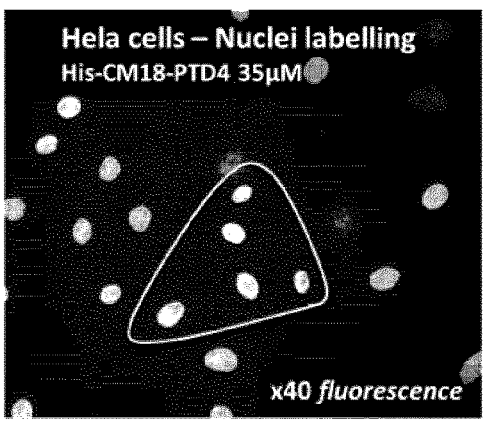
Figure 45D:
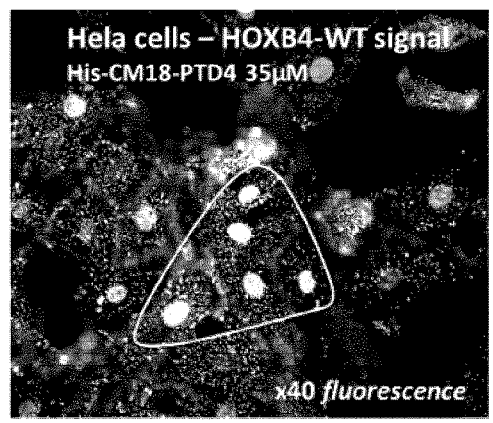

Data from FIG. 44

| Cargo/shuttle agent (FIG. 42) | Cells | Conc. of shuttle (µM) | Conc. of HOXB4-WT (µM) | Exposure time (hours) | Fold over control (mean ± St. Dev) | Total RNA in ng/µL (mean ± St. Dev) |
|---|---|---|---|---|---|---|
| No treatment ("Ctrl") | THP-1 | 0 | 0 | — | 1 ± 0.1 | 289 ± 9.2 |
| His-CM18-PTD4 alone ("FS") | THP-1 | 0 | 0.3 | 2.5 h | 2.5 ± 0.2 | 260 ± 7.1 |
| HOXB4-WT alone ("TF") | THP-1 | 0.8 | 0 | 2.5 h | 1 ± 0.14 | 264 ± 12.3 |
| His-CM18-PTD4 + HOXBA-WT | THP-1 | 0.8 | 0.3 | 4 h | 1.2 ± 0.1 | 198 ± 6.0 |
| | | | | 3 h | 1.3 ± 0.21 | 268 ± 12.5 |
| | | | | 2.5 h | 2 ± 0.3 | 275 ± 4.7 |
| | | | | 2 h | 2.2 ± 0.2 | 269 ± 12.5 |
| | | | | 1 | 9.7 ± 2.6 | 268 ± 3.9 |
| | | | | 0.5 | 23.1 ± 2.0 | 266 ± 17.5 |
| | | | | 0 | 4 ± 0.5 | 217 ± 6.4 |

14.6 HOXB4-WT Transduction by His-CM18-PTD4 in HeLa Cells: Immuno-Labelling and Visualization by Microscopy Recombinant HOXB4-WT transcription factor (25 µM; Example 14.1) was co-incubated with 35 µM of His-CM18-PTD4 and exposed to HeLa cells for 10 seconds using Protocol B as described in Example 9.1. After a 30-minute incubation to allow transduced HOXB4-WT to accumulate in the nucleus, the cells were fixed, permeabilized and immuno-labelled as described in Example 3.2a. HOXB4-WT was labelled using a primary mouse anti-HOXB4 monoclonal antibody (Novus Bio #NBP2-37257) diluted 1/500, and a secondary anti-mouse antibody Alexa™-594 (Abcam #150116) diluted 1/1000. Nuclei were labelled with DAPI. The cells were visualized by bright field and fluorescence microscopy at 20× and 40× magnifications as described in Example 3.2, and sample results are shown in FIG. 45. Co-localization was observed between nuclei labelling (FIGS. 45A and 45C) and HOXB4-WT labelling (FIGS. 45B and 45D), indicating that HOXB4-WT was successfully delivered to the nucleus after 30 min in the presence of the shuttle agent His-CM18-PTD4. White triangle windows show examples of areas of co-localization between the nuclei (DAPI) and HOXB4-WT immuno-labels.

14.7 HOXB4-WT Transduction by Different Shuttle Agents in THP-1 Cells: Dose Responses and Viability THP-1 cells were cultured and tested in the protein transduction assay using Protocol A as described in Example 9.1. Briefly, THP-1 cells were plated at 30 000 cells/well one day before the first time course experiment. HOXB4-WT recombinant protein (1.5 µM; Example 14.1) co-incubated with the shuttle agents His-CM18-PTD4, TAT-KALA, EB1-PTD4, His-C(LLKK)3C-PTD4 and His-CM18-PTD4-His at 0.8 µM, and then exposed to THP-1 cells for 2.5 hours in presence of serum. The cells were subjected to real time-PCR analysis as described in Example 14.2 to measure mRNA levels of a target gene as a marker for HOXB4 activity, which was then normalized to target gene mRNA levels detected in the negative control cells (no treatment), to obtain a "Fold over control" value. Total RNA levels (ng/μL) were also measured as a marker for cell viability. Results are shown in Table 14.4 and FIG. 47.

TABLE 14.4

Figure 47:
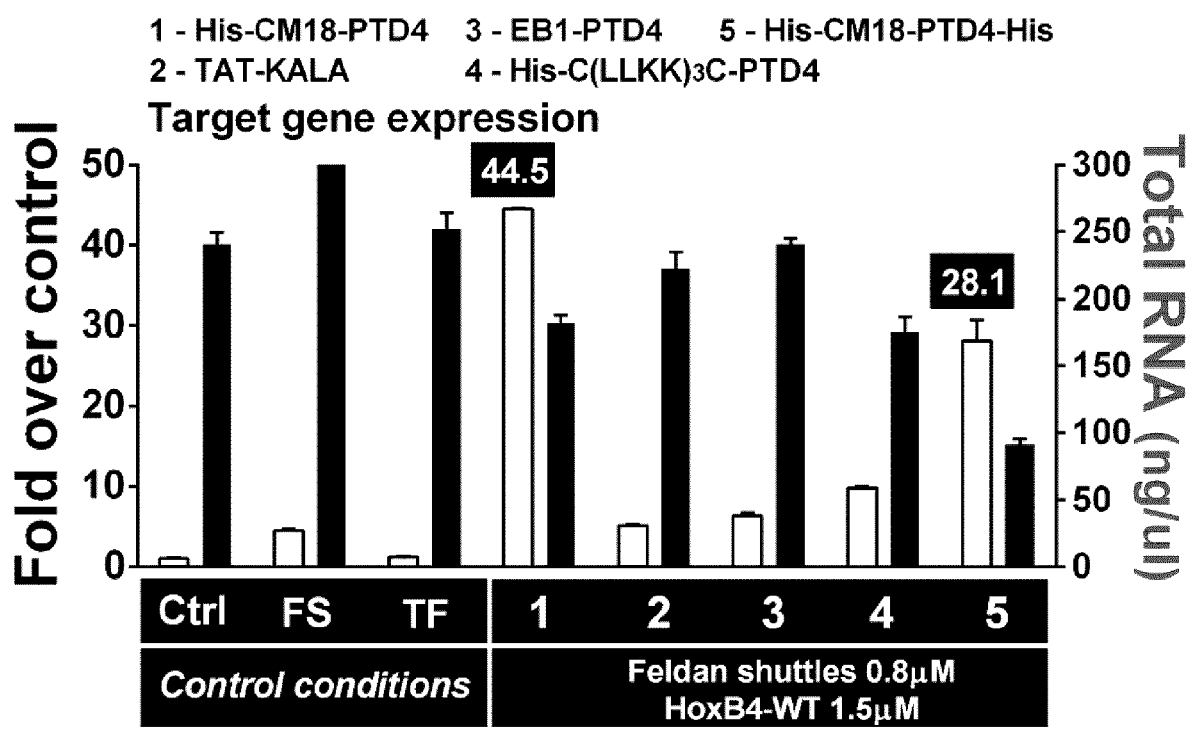
FIG. 47 shows the transcriptional activity of THP-1 cells that have been transduced with the transcription factor HOXB4 using the shuttle agents His-CM18-PTD4, TAT-KALA, EB1-PTD4, His-C(LLKK)3C-PTD4 and His-CM18-PTD4-His. Successful intra-nuclear delivery of HOXB4 was determined by monitoring mRNA levels of a target gene by real-time PCR, and the results were normalized against those in the negative control (HOXB4 without shuttle agent) and expressed as "Fold over control" (left bars). Total cellular RNA (ng/µL) was quantified and used a marker for cell viability (right bars). "0" or "Ctrl" means "no treatment"; "TF" means "Transcription Factor alone"; "FS" means "shuttle alone".

Data from FIG. 47

| Cargo/shuttle agent | Shuttle conc. (μM) | HOXB4-WT Conc. (μM) | Exposure time | Fold over control (mean ± St. Dev) | Total RNA in ng/μL (mean ± St. Dev) |
|---|---|---|---|---|---|
| No treatment ("Ctrl") | 0 | 0 | — | 1 ± 0.09 | 240.3 ± 8.9 |
| His-CM18-PTD4 alone ("FS") | 0 | 1.5 | 2.5 h | 2.5 ± 0.3 | 303.9 ± 7.6 |
| HOXB4-WT alone ("TF") | 0.8 | 0 | 2.5 h | 1 ± 0.11 | 251.9 ± 11.9 |
| His-CM18-PTD4 + HOXB4-WT | 0.8 | 1.5 | 2.5 h | 44.5 ± 0.09 | 182 ± 5.97 |
| TAT-KALA + HOXB4-WT | | | | 5.1 ± 0.21 | 222.4 ± 12.5 |
| EB1-PTD4 + HOXB4-WT | | | | 6.4 ± 0.3 | 240.4 ± 4.71 |
| His-C(LLKK)3C-PTD4 + HOXB4-WT | | | | 9.8 ± 0.19 | 175.3 ± 11.25 |
| His-CM18-PTD4-His + HOXB4-WT | | | | 28.1 ± 2.61 | 91.4 ± 3.92 |

Example 15

In Vivo GFP-NLS Delivery in Rat Parietal Cortex by His-CM18-PTD4

The ability of the shuttle agent His-CM18-PTD4 to deliver GFP-NLS in vivo in the nuclei of rat brain cells was tested.

In separate sterile 1.5-mL tubes, shuttle agent His-CM18-PTD4 was diluted in sterile distilled water at room temperature. GFP-NLS, used as cargo protein, was then added to the shuttle agent and, if necessary, sterile PBS was added to obtain the desired concentrations of shuttle agent and cargo in a sufficient final volume for injection in rat brain (e.g., 5 μL per each injection brain site). The shuttle agent/cargo mixture was then immediately used for experiments. One negative control was included for the experiment, which corresponds to the injection of the GFP-NLS alone.

Bilateral injections were performed in the parietal cortex of three rats. In the left parietal cortex (ipsilateral), a mix composed of the shuttle agent (20 μM) and the GFP-NLS (20 μM) was injected, and in the right parietal cortex (contralateral), only the GFP-NLS (20 μM) was injected as a negative control. For surgical procedures, mice were anesthetized with isoflurane. Then the animal was placed in a stereotaxic frame, and the skull surface was exposed. Two holes were drilled at the appropriate sites to allow bilateral infusion of the shuttle/cargo mix or GFP-NLS alone (20 μM) with 5-μL Hamilton syringe. Antero-posterior (AP), lateral (L), and dorso-ventral (DV) coordinates were taken relative to the bregma: (a) AP +0.48 mm, L ±3 mm, V −5 mm; (b) AP −2 mm, L ±1.3 mm, V −1.5 mm; (c) AP −2.6 mm, L ±1.5 mm, V −1.5 mm. The infused volume of the shuttle/cargo mix or cargo alone was 5 μL per injection site and the injection was performed for 10 minutes. After that, experimenter waited 1 min before removing the needle from the brain. All measures were taken before, during, and after surgery to minimize animal pain and discomfort. Animals were sacrificed by perfusion with paraformaldehyde (4%) 2 h after surgery, and brain were collected and prepared for microscopy analysis. Experimental procedures were approved by the Animal Care Committee in line with guidelines from the Canadian Council on Animal Care.

Figure 48:
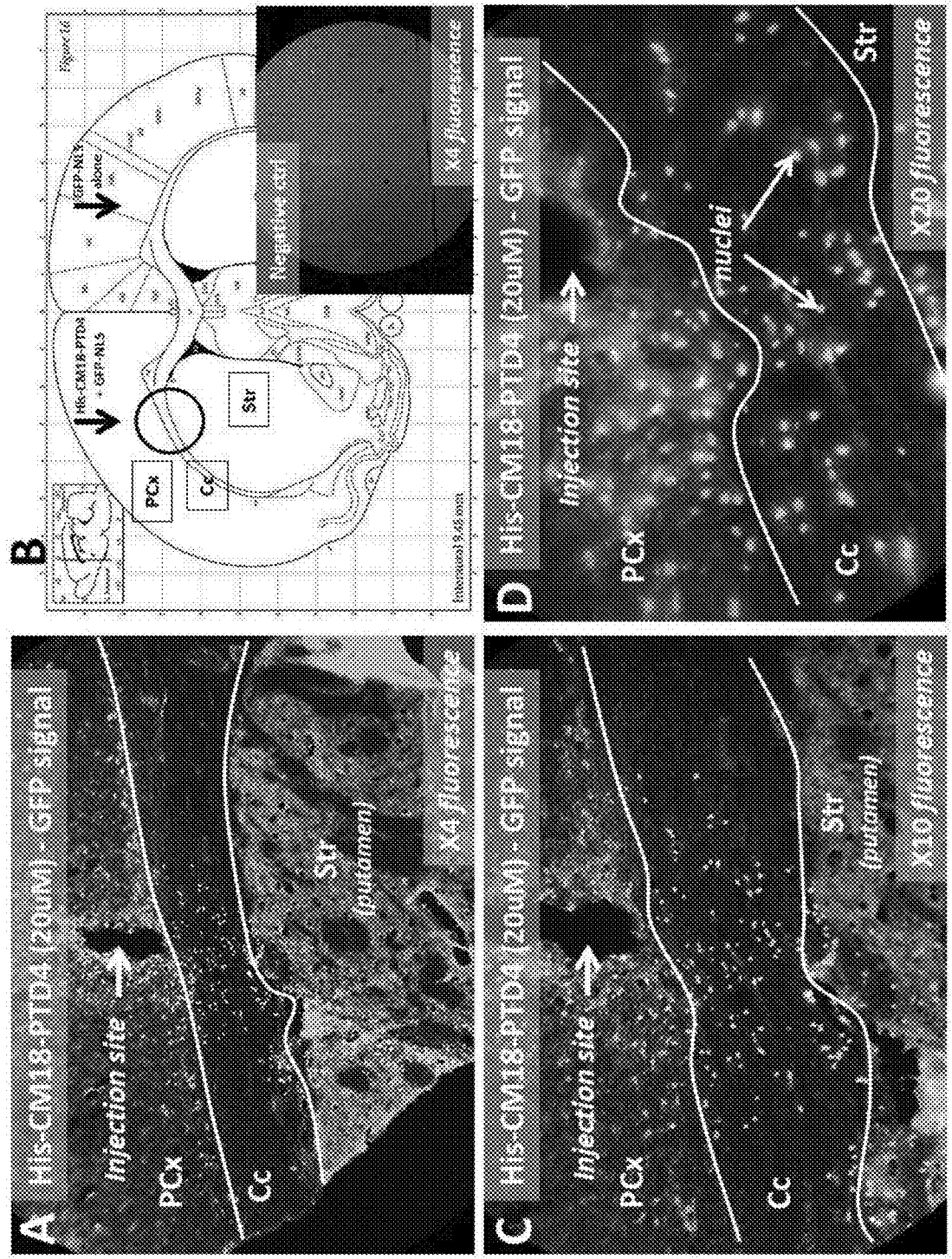
FIGS. 48A-48D show in vivo GFP-NLS delivery in rat parietal cortex by His-CM18-PTD4. Briefly, GFP-NLS (20 µM) was injected in the parietal cortex of rat in presence of the shuttle agent His-CM18-PTD4 (20 µM) for 10 min. Dorso-ventral rat brain slices were collected and analyzed by fluorescence microscopy at 4× (FIG. 48A), 10× (FIG. 48C) and 20× magnifications (FIG. 48D). The injection site is located in the deepest layers of the parietal cortex (PCx). In presence of the His-CM18-PTD4 shuttle agent, the GFP-NLS diffused in cell nuclei of the PCx, of the Corpus Callus (Cc) and of the striatum (Str) (white curves mark limitations between brains structures).

Dorso-ventral rat brain slices were collected and analysed by fluorescence microscopy and results are shown in at 4× (FIG. 48A), 10× (FIG. 48C) and 20× (FIG. 48D) magnifications. The injection site is located in the deepest layers of the parietal cortex (PCx). In the presence of the His-CM18-PTD4 shuttle, the GFP-NLS diffused in cell nuclei of the PCx, of the Corpus Callus (Cc) and of the striatum (Str) (White curves mean limitations between brains structures). FIG. 48B shows the stereotaxic coordinates of the injection site (black arrows) from the rat brain atlas of Franklin and Paxinos. The injection of GFP-NLS in presence of His-CM18-PTD4 was performed on the left part of the brain, and the negative control (an injection of GFP-NLS alone), was done on the contralateral site. The black circle and connected black lines in FIG. 48B show the areas observed in the fluorescent pictures (FIGS. 48A, 48C and 48D).

This experiment demonstrated the cell delivery of the cargo GFP-NLS after its stereotaxic injection in the rat parietal cortex in the presence of the shuttle agent His-CM18-PTD4. Results show the delivery of the GFP-NLS in the nucleus of cells from the deeper layers of the parietal cortex (injection site) to the corpus callus and the dorsal level of the striatum (putamen). In contrast, the negative control in which GFP-NLS is only detectable locally around the injection site. This experiment shows that shuttle agent induced nuclear delivery of the cargo in the injection site (parietal cortex) and its diffusion through both neighboring brain areas (corpus callus and striatum rat brain).

Example A

Physiochemical Properties of Domain-Based Peptide Shuttle Agents

A plurality of different peptides was initially screened with the goal of identifying polypeptide-based shuttle agents that can deliver independent polypeptide cargos intracellularly to the cytosol/nucleus of eukaryotic cells. On one hand, these large-scale screening efforts led to the discovery that domain-based peptide shuttle agents (see Examples 1-15), comprising an endosome leakage domain (ELD) operably linked to a cell penetrating domain (CPD), and optionally one or more histidine-rich domains, can increase the transduction efficiency of an independent polypeptide cargo in eukaryotic cells, such that the cargo gains access to the cytosol/nuclear compartment. Conversely, these screening efforts revealed some peptides having no or low polypeptide cargo transduction power, excessive toxicity, and/or other undesirable properties (e.g., poor solubility and/or stability).

Based on these empirical data, the physiochemical properties of successful, less successful, and failed peptides were compared in order to better understand properties common to the more successful shuttle agents. This approach involved manually stratifying the different peptides according to transduction performance with due consideration to, for example: (1) their solubility/stability/ease of synthesis; (2) their ability to facilitate endosomal escape of calcein (e.g., see Example 2); (3) their ability to deliver one or more types of independent polypeptide cargo intracellularly, as evaluated by flow cytometry (e.g., see Examples 3-6 and 8-15) in different types of cells and cell lines (e.g., primary, immortalized, adherent, suspension, etc.) as well as under different transduction protocols; and (4) their ability to deliver polypeptide cargos to the cytosol and/or nucleus, as evaluated by fluorescence microscopy (e.g., for fluorescently labelled cargos), increased transcriptional activity (e.g., for transcription factor cargos), or genome editing capabilities (e.g., for nuclease cargos such as CRISPR/Cas9 or CRISPR/Cpf1) (e.g., see Examples 3-6 and 8-15), and toxicity towards different types of cells and cell lines (e.g., primary, immortalized, adherent, suspension, etc.), under different transduction protocols.

In parallel to the above-mentioned manual curation, the transduction power and cellular toxicity of each peptide for a given fluorescently-labelled cargo (GFP, GFP-NLS, or fluorescently-labelled antibodies) and cell line were combined into a single "transduction score" as a further screening tool, which was calculated as follows: [(Highest percentage transduction efficiency observed by flow cytometry for a given peptide in a cell type)×(Percentage viability for the peptide in the tested cell line)]/1000, giving an overall transduction score between 0 and 10 for a given cell type and polypeptide cargo. These analyses identified domain-based peptides having transduction scores ranging from about 8 (e.g., for successful domain-based peptide shuttle agents) to as low as 0.067 (e.g., for single-domain negative control peptides).

The above-mentioned manual curation and "transduction score"-based analyses revealed a number of parameters that are common to many successful domain-based shuttle agents. Some of these parameters are listed in the Table A1. An example of a "transduction score"-based analyses in HeLa cells using GFP as a polypeptide cargo is shown in Table A2. Other transduction score-based analyses using cell lines other than HeLa and polypeptides cargos other than GFP, were also performed but are not shown here for brevity.

No successful shuttle agents were found having less than 20 amino acid residues in length (see parameter 1 in Tables A1 and A2). The four amino acids alanine, leucine, lysine and arginine, were the principal and most recurrent residues in most of the successful shuttle agents (35-85% of residues of the peptide; see parameter 10). These residues dictate the alpha-helical structure and amphiphilic nature of these peptide sequences (parameters 2-5). There was often a balance between the percentages of A/L residues (15-45%) and K/R residues (20-45%) in the shuttle agents (parameters 11, 12 and 14), and the percentages of negatively charged residues was often found to be not greater than 10% (parameter 14). Conversely, the sixteen other amino acid residues (other than A, L, K, and R) represented generally between 10-45% of the shuttle agents (parameter 15). Successful shuttle agents generally had a predicted isoelectric point (pI) of between 8-13 (parameter 7), and a predicted net charge greater than or equal to +4 (parameter 6), with dCM18-TAT-Cys having a predicted net charge of as high as +26. Hydrophobic residues (A, C, G, I, L, M, F, P, W, Y, V) composed generally between 35-65% of the shuttle agents, and neutral hydrophilic residues (N, Q, S, T) represented generally from 0-30% (parameters 8 and 9).

As shown in Table A2, the most successful shuttle agents (e.g., transduction scores above 5.0) generally had few parameters outside the ranges set forth in Table A1. However, significant increases in transduction efficiency were also observed for shuttle agents in which several parameters were not satisfied, depending for example on the extent to which the unsatisfied parameters fall outside the recommended range, and/or on whether other parameters fall closer to the middle of a recommended range. Thus, shuttle agents having several parameters which fall within "optimal" ranges may compensate for other parameters falling outside of the recommended ranges. As mentioned above, peptides shorter than 20 amino acids did not show any significant transduction ability (e.g. transduction scores less than 0.4), regardless of how many other parameters were satisfied. Among the peptides greater than 20 amino acids in length and having transduction scores lower than 0.4, VSVG-PTD4 (score of 0.35) failed to satisfy six parameters, while JST-PTD4 (score of 0.083) failed to satisfy ten parameters. KALA (score of 0.12) failed to satisfy four parameters, with parameters 11 and 14 far exceeding the recommended ranges, reflecting an overabundance of A/L residues and a large imbalance between the percentages of A/L and L/R residues. It is to be understood that the transduction score ranges appearing the Table A2 are arbitrarily selected, and that other ranges can be selected and are within the scope of the present description.

TABLE A1

General physicochemical properties of successful domain-based peptide shuttle agents

| | Parameter | Description | Result |
|---|---|---|---|
| 1 | Minimum length | The minimum length of peptide shuttle agent. | 20 amino acids |
| 2 | Amphipathic alpha-helix | Peptide shuttle agent comprises a predicted amphipathic alpha-helix conformation, (Based on 3D modeling using PEP-FOLD, an online resource for de novo peptide structure prediction: http://bioserv.rpbs.univ-paris-diderot.fr/services/PEP-FOLD/). | Yes |
| 3 | Positively-charged surface | Predicted amphipathic alpha-helix conformation comprises a positively-charged hydrophilic face rich in R and/or K residues, (Based on observation of at least 3 K/R residues clustered to one side of a helical wheel modeling, using the online helical wheel projection tool available at: http://rzlab.ucr.edu/scripts/wheel/wheel.cgi). | Yes |

TABLE A1-continued

General physicochemical properties of successful domain-based peptide shuttle agents

| | Parameter | Description | Result |
|---|---|---|---|
| 4 | % Highly hydrophobic core | Predicted amphipathic alpha-helix conformation comprises a highly hydrophobic core composed of spatially adjacent L, I, F, V, W, and/or M residues representing a percentage of the overall peptide sequence (calculated excluding histidine-rich domains). This parameter was calculated by first arranging the amino acids of the peptide in an opened cylindrical representation, then delineating an area of contiguous highly hydrophobic residues (L, I, F, V, W, M), as shown in FIG. 49A, right panel. The number of highly hydrophobic residues comprised in this delineated highly hydrophobic core was then divided by the total amino acid length of the peptide, excluding N- and/or C-terminal histidine-rich domains. For example, for the peptide shown in FIG. 49A, there are 8 residues in the delineated highly hydrophobic core, and 25 total residues in the peptide (excluding the terminal 12 histidines). Thus, the highly hydrophobic core is 32% (8/25). | 12-50% |
| 5 | Hydrophobic moment | Calculated hydrophobic moment (μ; calculated while excluding histidine-rich domains), using the online helical wheel projection program available from: http://rzlab.ucr.edu/scripts/wheel/wheel.cgi. | 3.5-11 |
| 6 | Net charge | Predicted net charge at physiological pH (calculated from the side chains of K, R, D, and E residues). | ≥+4 |
| 7 | pI | Predicted isoelectric point (pI). (Calculated with the Prot Param software available at: http://web.expasy.org/protparam/). | 8-13 |
| 8 | % hydrophobic residues | Overall percentage of hydrophobic residues (A, C, G, I, L, M, F, P, W, Y, V) in the peptide shuttle agent. | 35-65% |
| 9 | % neutral hydrophilic residues | Overall percentage of neutral hydrophilic residues (N, Q, S, T) in the peptide shuttle agent. | 0-30% |
| 10 | % A, L, K, R | Overall percentage of residues in the peptide shuttle agent which are A, L, K, or R. | 35-85% |
| 11 | % A or L | Overall percentage of residues in the peptide shuttle agent which are A or L. (Number of A + L residues)/(Total number of residues), with there being at least 5% of L in the peptide. | 15-45% |
| 12 | % Positive residues | Overall percentage of residues in the peptide shuttle agent which are K or R. (Number of K + R residues)/(Total number of residues). | 20-45% |
| 13 | % Negative residues | Overall percentage of residues in the peptide shuttle agent which are D or E. (Number of D + E residues)/(Total number of residues). | 0-10% |
| 14 | Difference between % of A/L and K/R | Overall difference (absolute value) between the percentage of A or L (parameter 11) and the percentage of K or R (parameter 12) in the peptide shuttle agent. (Parameter 11) − (Parameter 12). | ≤10% |
| 15 | % infrequent amino acid residues | Overall percentage of residues which are Q, Y, W, P, I, S, G, V, F, E, D, C, M, N, T or H (i.e., not A, L, K, or R). (Number of Q + Y + W + P + I + S + G + V + F + E + D + C + M + N + T + H residues)/(Total number of residues). | 10-45% |

TABLE A2

Physiochemical properties of domain-based peptides stratified by transduction score (in HeLa cells using GFP or GFP-NLS as cargo)

| Peptide name | 1 | 2 | 3 | 4 | 5 | 6 | 7 | 8 | 9 | 10 | 11 | 12 | 13 | 14 | 15 |
|---|---|---|---|---|---|---|---|---|---|---|---|---|---|---|---|
| Transduction scores between 3.1-8.0 | | | | | | | | | | | | | | | |
| TAT-KALA | 42 | Y | Y | 12.1 | 3.6 | 13 | 11.5 | 54.5 | 7.5 | 81 | 43.9 | 36.5 | 4.9 | 7.3 | 11.9 |
| His-CM18-PTD4-His | 41 | Y | Y | 24.1 | 6.7 | 8 | 11.8 | 51.6 | 8.1 | 52 | 22.6 | 23 | 0 | −5.7 | 26.8 |
| His-CM18-PTD4 | 35 | Y | Y | 26 | 6.7 | 8 | 11.8 | 51.6 | 8.1 | 52 | 22.6 | 23 | 0 | −5.7 | 31.4 |
| His-C(LLKK)₃C-PTD4 | 31 | Y | Y | 24 | 3.6 | 9 | 11.2 | 45.8 | 2.7 | 43 | 20 | 22.9 | 2.9 | −2.9 | 35.5 |
| CM18-L2-PTD4 | 36 | Y | Y | 22.2 | 6.9 | 8 | 11.8 | 63.9 | 14 | 50 | 27.7 | 22.2 | 0 | 5.5 | 50 |
| CM18-His-PTD4 | 35 | Y | Y | 22.8 | 6.7 | 8 | 11.8 | 51.6 | 8.1 | 52 | 22.6 | 23 | 0 | −5.7 | 31.4 |
| CM18-PTD4-His | 35 | Y | Y | 22.8 | 6.7 | 8 | 11.8 | 51.6 | 8.1 | 52 | 22.6 | 23 | 0 | −5.7 | 31.4 |
| His-CM18-TAT | 35 | Y | Y | 24.1 | 6 | 13 | 12.3 | 37.4 | 8.6 | 49 | 11.5 | 37.1 | 0 | −25 | 34.4 |
| EB1-PTD4 | 34 | Y | Y | 26.5 | 6.3 | 10 | 12.3 | 52.8 | 14.6 | 59 | 29.4 | 29 | 0 | 0 | 35.3 |
| Transduction scores between 0.5-3.0 | | | | | | | | | | | | | | | |
| HA-CM18-PTD4 | 36 | Y | Y | 26.6 | 6.7 | 8 | 11.8 | 52.4 | 8.9 | 53 | 30.5 | 22.2 | 0 | 8.3 | 30.6 |
| 6Cys-CM18-PTD4 | 35 | Y | Y | 22.6 | 6.5 | 8 | 9.7 | 68.7 | 8.6 | 52 | 28.6 | 22.9 | 0 | 3.7 | 48.8 |
| CM18-L3-PTD4 | 41 | Y | Y | 19.5 | 3.9 | 8 | 11.8 | 64 | 16.3 | 44 | 24.4 | 19.5 | 0 | 4.9 | 51.3 |
| His-CM18-PTD4–6Cys | 41 | Y | Y | 32 | 6.8 | 8 | 9.7 | 58.4 | 2.4 | 44 | 24.4 | 19.5 | 0 | 4.9 | 41.5 |
| Met-His-CM18-TAT-Cys | 37 | Y | Y | 20 | 6.2 | 13 | 12 | 54 | 8.1 | 49 | 10.8 | 21.6 | 0 | 5.4 | 35.2 |
| CM18-L1-PTD4 | 32 | Y | Y | 25.8 | 6.1 | 8 | 11.8 | 59.1 | 14.9 | 56 | 31.3 | 25 | 0 | −11 | 43.8 |
| Xentry-KALA | 37 | Y | Y | 25 | 5.2 | 6 | 9.9 | 67.3 | 0.7 | 76 | 54 | 21.6 | 5.4 | 32 | 16.2 |
| CM18-TAT-Cys | 30 | N | N | 10.8 | 6.2 | 13 | 12 | 46.3 | 10 | 57 | 13.3 | 43.3 | 0 | −30 | 43.5 |
| Pep1-KALA | 51 | Y | Y | 26.6 | 9.1 | 8 | 10 | 51.1 | 58.9 | 61 | 35.3 | 25.5 | 9.8 | 9.8 | 27.5 |
| 3HA-CM18-PTD4 | 38 | Y | Y | 15.9 | 6.7 | 8 | 11.8 | 57.9 | 7.9 | 55 | 34.2 | 21.1 | 0 | 13.1 | 29 |
| CM18-PTD4 | 29 | Y | Y | 24.2 | 6.7 | 8 | 11.8 | 60.8 | 10.3 | 62 | 34.4 | 27.5 | 0 | 6.9 | 38 |
| 3His-CM18-PTD4 | 32 | Y | Y | 27.6 | 6.7 | 8 | 11.8 | 56.1 | 9.3 | 56 | 29.4 | 25 | 0 | 0 | 34.5 |
| His-CM18-Transportan | 50 | Y | Y | 25 | 2.6 | 9 | 10.6 | 58 | 14 | 51 | 32 | 18 | 0 | 13 | 38 |
| SynB3-KALA | 40 | Y | Y | 22.8 | 3.7 | 10 | 11.1 | 57.5 | 5 | 78 | 47.5 | 30 | 5 | 17.5 | 15 |
| 12His-CM18-PTD4 | 41 | Y | Y | 15 | 6.7 | 8 | 11.8 | 46.4 | 8.8 | 44 | 24.4 | 21.2 | 0 | 4.9 | 26.9 |
| TAT-CM18 | 30 | Y | Y | 27.6 | 4 | 13 | 12 | 46.6 | 10 | 57 | 13.3 | 43.3 | 0 | −30 | 43.5 |
| 9Arg-KALA | 39 | Y | Y | 23.5 | 4.5 | 14 | 12.1 | 51.4 | 0 | 87 | 46.2 | 41 | 5.1 | 5.2 | 5.1 |

TABLE A2-continued

Physiochemical properties of domain-based peptides stratified by transduction score
(in HeLa cells using GFP or GFP-NLS as cargo)

| Peptide name | Parameter | | | | | | | | | | | | | | |
|---|---|---|---|---|---|---|---|---|---|---|---|---|---|---|---|
| | 1 | 2 | 3 | 4 | 5 | 6 | 7 | 8 | 9 | 10 | 11 | 12 | 13 | 14 | 15 |
| | Transduction scores between 0.07–0.4 | | | | | | | | | | | | | | |
| VSVG-PTD4 | 36 | N | N | 11.1 | 4.1 | 6 | 10.3 | 47.4 | 14 | 33 | 16.7 | 16.6 | 0 | 0.1 | 61.3 |
| Penetratin-cys | 17 | N | N | 23.5 | 5.5 | 7 | 11.8 | 41.3 | 17.7 | 41 | 0 | 41.1 | 0 | −41 | 58.8 |
| CM18 | 18 | N | N | 47 | 4.3 | 5 | 10.6 | 61.3 | 11.1 | 50 | 22.3 | 27.8 | 0 | −5.5 | 50 |
| KALA | 30 | Y | Y | 20 | 4.5 | 5 | 9.9 | 66.6 | 0 | 83 | 60 | 23.3 | 6.7 | 36.7 | 6.7 |
| TAT-cys | 12 | N | N | 0 | 1.9 | 8 | 12 | 24.9 | 8.3 | 57 | 0 | 67 | 0 | −67 | 33.3 |
| PTD4 | 11 | Y | Y | 0 | 2.4 | 3 | 11.7 | 64.6 | 9.1 | 82 | 54.5 | 27.3 | 0 | 27.2 | 18.2 |
| His-PTD4 | 17 | Y | Y | 0 | 2.4 | 3 | 11.7 | 41.2 | 5.9 | 53 | 35.3 | 17.6 | 0 | 17.7 | 11.8 |
| JST-PTD4 | 31 | N | N | 35.6 | 13.8 | 2 | 4.7 | 67.6 | 9.6 | 65 | 54.8 | 9.7 | 16.1 | 45.1 | 19.4 |
| C(LLKK)₃C | 14 | Y | Y | 42.9 | 5 | 6 | 10.1 | 57.2 | 0 | 86 | 42.9 | 42.9 | 0 | 0 | 14.3 |

Y = Yes;
N = No;
Regular font = value falls within parameter range set forth in Table A1;
Bolded font = value falls outside parameter range set forth in Table A1.
His-LAH4-PTD4 yielded a transduction score of above 5.0, but was excluded from this analysis because the intracellular GFP fluorescence pattern was observed by fluorescence microscopy as being punctate, suggesting that the GFP cargo remained trapped in endosomes. Nevertheless, it is worth noting that His-LAH4-PTD4 had several parameters falling outside the ranges set forth in Table A1 with respect to parameters 2, 3, 11, 12, 14 and 15.

Example B

Rational Design of Synthetic Peptide Shuttle Agents

The parameters set forth in Table A1, and empirical knowledge gained (e.g., from Examples 1-15), were used to manually design the peptides listed in Table B1 in order to evaluate whether the parameters can be used for designing successful peptide shuttle agents.

The peptides listed in Table B1 were tested for their ability to transduce GFP-NLS cargo (see Example 3.4) in HeLa cells, using the protein transduction assay as generally described in Example 3.1a. GFP-NLS recombinant protein (10 µM) was co-incubated with 10 µM of the peptides and then exposed to HeLa cells for 1 min. The cells were subjected to flow cytometry analysis as described in Example 3.3. Results are shown in Tables B2 and B3. A "transduction score"-based analysis was also performed as discussed is Example A, and the results are shown in Table B4. Successful nuclear delivery of the transduced GFP-NLS (generally after only 1 minute of exposure to the peptide) was confirmed by fluorescence microscopy as described in Example 3.2 (data not shown).

Peptides FSD1-FSD5 were initially designed based on the successful domain-based shuttle agent His-CM18-PTD4-His, with peptides FSD1-FSD4 being designed to intentionally unrespect one or more parameters set forth in Table A1, and FSD5 being designed to respect all fifteen parameters. As can be seen from Table B2, peptides FSD1-FSD4 displayed transduction efficiencies ranging from 2.45% to 37.6%. In contrast, the peptide FSD5 displayed high transduction efficiency (70.5%) and low toxicity (cell viability of 86%).

Figure 49C:
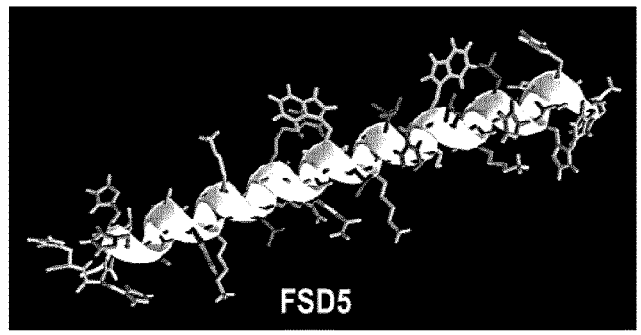
FIGS. 49C-49F show predicted 3-dimensional models of the structures of the peptides FSD5, FSD18, VSVG-PTD4, and a peptide having two beta-sheets and no alpha helices, respectively.
Figure 49D:
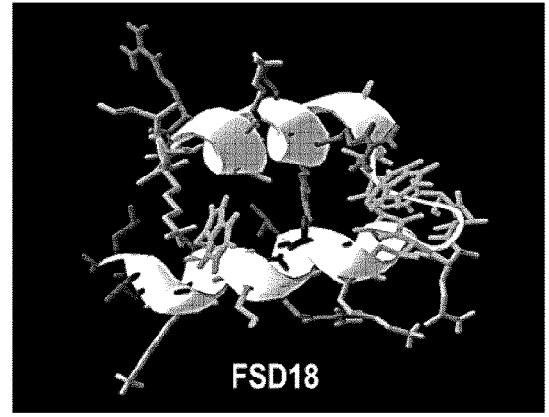
Figure 49E:
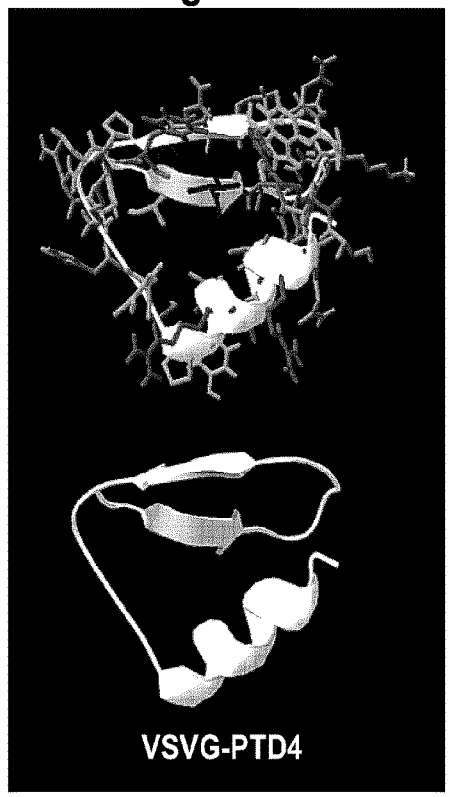
Figure 49F:
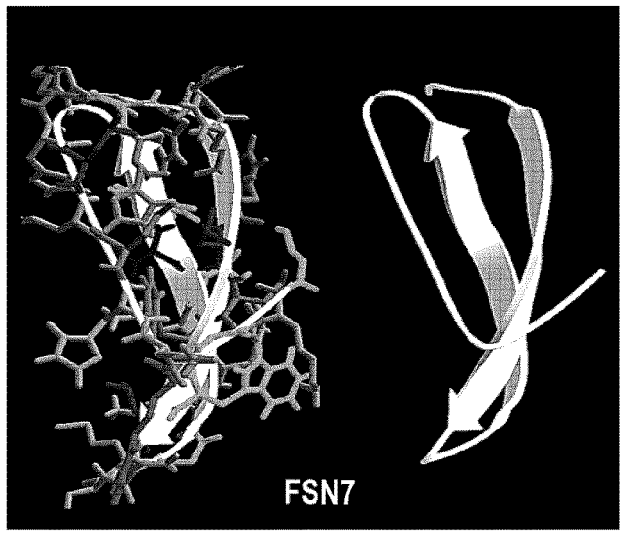

3-dimensional modeling using PEP-FOLD, an online resource for de novo peptide structure prediction, predicted an alpha-helical conformation for FSD5 (see FIG. 49C; http://bioserv.rpbs.univ-paris-diderot.fr/services/PEP-FOLD/). In contrast, the peptide VSVG-PTD4, which showed only 3.5% transduction efficiency (see Table 10.3a), was predicted to adopt a different structure which included a shorter alpha helix, short beta-sheets (white arrows), and random coils (white shapeless lines).

Helical wheel projections and side opened cylindrical representations of FSD5 and VSVG-PTD4 shown in FIGS. 49A and 49B (adapted from: http://rzlab.ucr.edu/scripts/wheel/wheel.cgi) illustrate the amphipathic nature of FSD5, as compared to VSVG-PTD4. The geometrical shape of each amino acid residue corresponds to its biochemical property based on the side chain of the residue (i.e., hydrophobicity, charge, or hydrophilicity). One of the main differences between the two opened cylindrical representations of FSD5 and VSVG-PTD4 is the presence of a highly hydrophobic core in FSD5 (outlined in FIG. 49A, left and right panels), which is not present in VSVG-PTD4. The cylinder in the lower middle panels of FIGS. 49A and 49B represent simplified versions of the opened cylindrical representations in the right panels, in which: "H" represents the high hydrophobic surface area; "h" represents low hydrophobic surface area; "+" represents positively charged residues; and "h" represent hydrophilic residues.

In light of the high transduction efficiency of FSD5, we used this shuttle agent as model to design peptides FSD6-FSD26. As shown in Table B2, a relatively high degree of amino acid substitutions was possible without completely losing transduction power, provided that most of the design parameters set forth in Table A1 were respected. The only peptide that displayed nearly a complete loss transduction efficiency among FSD6-FSD26 was FSD6, which is not predicted to adopt an amphipathic alpha-helix structure. Interestingly, peptide FSD18 showed high toxicity in HeLa cells when used at 10 µM, but showed high transduction efficiency and relatively low toxicity when used in other types of cells (see Examples E and G), suggesting that peptide toxicity may vary depending on the type of cells. 3-dimensional modeling using PEP-FOLD predicted two separate alpha-helices for FSD18 (see FIG. 49O).

Peptides FSN1-FSN8 were designed to explore the effects on transduction efficiency when one or more of the design parameters set forth in Table A1 are not respected.

TABLE B1

Manually-designed synthetic peptides and shuttle agents

| Peptide | SEQ ID NO: | Amino acid sequence | Length (a.a.) | MW (kDa) | pI | Charge |
|---|---|---|---|---|---|---|
| FSD1 | 104 | HHHHHHKWKLLRRAAKKAARRYLKLLLKQLKLHHHHHH | 38 | 4.85 | 12.03 | 11+/0− |
| FSD2 | 105 | HHHHHHWLKLLRRAAKKAARLYRKLLRKARKLHHHHHH | 38 | 4.86 | 12.31 | 12+/0− |
| FSD3 | 106 | HHHHHHKRKKKRRAKKKRAWLYLALLLWALALHHHHHH | 38 | 4.87 | 12.03 | 11+/0− |
| FSD4 | 107 | HHHHHHKRQLKRKLRKWKRLLRLLRLLARLWLHHHHHH | 38 | 5.1 | 12.78 | 12+/0− |
| FSD5 | 108 | HHHHHHLLKLWSRLLKLWTQGRRLKAKRAKAHHHHHH | 37 | 4.68 | 12.49 | 9+/0− |
| FSD6 | 109 | HHHHHHWYLALLALYWQRAKAKTRQRRRHHHHHH | 34 | 4.49 | 11.84 | 7+/0− |
| FSD7 | 110 | HHHHHHWARLARAFARAIKKLYARALRRQARTG | 33 | 3.99 | 12.4 | 9+/0− |
| FSD8 | 111 | HHHHHHKWKLARAFARAIKKLYARALRRQARTG | 33 | 4.02 | 12.31 | 10+/0− |
| FSD9 | 112 | HHHHHHKWKLARAFARAIKKLYARALRRQARTGHHHHHH | 39 | 4.85 | 12.31 | 10+/0− |
| FSD10 | 113 | KWKLARAFARAIKKLGGSGGGSYARALRRQARTG | 34 | 3.66 | 12.31 | 10+/0− |
| FSD11 | 114 | HHHHHHKWKLARAFARALRAIKKLYARALRRQARTG | 36 | 4.36 | 12.4 | 11+/0− |
| FSD12 | 115 | KWKLARAFARAIKKLYARALRRQARTG | 27 | 3.2 | 12.31 | 10+/0− |
| FSD13 | 116 | HHHHHHKWAKLLRAFAKAIKKLYARLARRQARTGHHHHHH | 40 | 4.93 | 12.19 | 10+/0− |
| FSD14 | 117 | HHHHHHLALARWARYFRILAKLKRTKRGQAKAHHHHHH | 38 | 4.73 | 12.19 | 9+/0− |
| FSD15 | 118 | HHHHHHKWKIARAFARSLKKLYARLLARQAKTGHHHHHH | 39 | 4.79 | 12.02 | 9+/0− |
| FSD16 | 119 | HHHHHHLLKLWSRLLKLWTQGRRLKAKRAKA | 31 | 3.86 | 12.49 | 9+/0− |
| FSD17 | 120 | HHHHHHLAKLFKWLRALIRQGAKRKTKRASAHHHHHH | 37 | 4.56 | 12.49 | 9+/0− |
| FSD18 | 121 | LLKLWSRLLKLWTQGGSGGGSGRRLKAKRAKA | 32 | 3.49 | 12.49 | 9+/0− |
| FSD19 | 122 | HHHHHHLLKLWSRLLKTWTQGRRLKAKSAQASTRQAHHHHHH | 36 | 4.32 | 12.48 | 8+/0− |
| FSD20 | 123 | HHHHAAVLKLWKRLLKLFRKGRRLKAKRAKAKR | 33 | 4.12 | 12.71 | 14+/0− |
| FSD21 | 124 | HHHHHHFLKIWSRLIKIWTQGRRKGAQAAFR | 31 | 3.85 | 12.48 | 7+/0− |
| FSD22 | 125 | HHHHHHVLKLWSRILKAFTQGRRMAAKRAKCNHHHHHH | 32 | 3.87 | 12.02 | 8+/0− |
| FSD23 | 126 | HHHHHHLLKLWSRLLKEWTQGRRLEAKRAEAHHHHHH | 31 | 3.88 | 10.93 | 7+/3− |
| FSD24 | 127 | HHHHHHLLCLWSRLLKLWTQGERLKAKCAKACER | 34 | 4.14 | 9.75 | 7+/2− |
| FSD25 | 128 | HHHHHHVWKLFWTLLAAIYGRGKARQKRAKRQARG | 35 | 4.25 | 12.19 | 9+/0− |
| FSD26 | 129 | ALLGLFIKWVKKVGTLFRKAKAGAQNRRAKAQKGK | 35 | 3.88 | 12.33 | 11+/0− |
| FSN1 | 130 | HHHHHHKRKRRSKARKLWTQGWLLLALLALAHHHHHH | 31 | 3.86 | 12.49 | 9+/0− |
| FSN2 | 131 | HHHHHHKLKLRSRLKWGRTQLWRALAKKALLHHHHHH | 31 | 3.86 | 12.49 | 9+/0− |
| FSN3 | 132 | HHHHHHQFLCFWLNKMGKHNTVWHGRHLKCHKRGKG | 31 | 3.82 | 11.75 | 7+/0− |
| FSN4 | 133 | HHHHHHLLYLWRRLLKFWCAGRRVYAKCAKAYGCF | 35 | 4.23 | 10.06 | 7+/0− |
| FSN5 | 134 | HHHHHHLLKLWRRLLKLFRKALRALAKRAKSALKRAQAA | 39 | 4.68 | 12.71 | 12+/0− |
| FSN6 | 135 | HHHHHHLLKLWSRLLKLWTQALRALAKRAKALAHHHHHH | 33 | 3.96 | 12.31 | 7+/0− |

TABLE B1-continued

Manually-designed synthetic peptides and shuttle agents

| Peptide | SEQ ID NO: | Amino acid sequence | Length (a.a.) | MW (kDa) | pI | Charge |
|---|---|---|---|---|---|---|
| FSN7 | 136 | LIKLWSRFIKFWTQGRRIKAKLARAGQSWFG | 31 | 3.75 | 12.48 | 8+/0− |
| FSN8 | 137 | HHHHHHFRKLWLAIVRAKK | 19 | 2.4 | 12.02 | 5+/0− |
| FSD43 to FSD116 | 169 to 242 | [Refer to Sequence Listing] | — | — | — | — |

Results computed using ProtParam ™ online tool available from ExPASy ™ Bioinformatics Resource Portal (http://web.expasy.org/protparam/);
pI: isoelectric point; Charge: Total number of positively (+) and negatively (−) charged residues

TABLE B2

Transduction of GFP-NLS in HeLa cells

| Cells | Peptide | Mean % cells with GFP signal (±St. Dev.; n = 3) | Cell viability (%) (±St Dev.; n = 3) | Design comments |
|---|---|---|---|---|
| HeLa | No peptide | 0.41 ± 0.015 | 100 | n/a |
| | FSD1 | 37.6 ± 3.44 | 60.3 ± 6.18 | Low % of infrequent amino acids (Q, Y, W, P, I, S, G, V, F, E, D, C, M, N, T, H) |
| | FSD2 | 11.9 ± 1.69 | 76.3 ± 5.99 | High hydrophobic moment |
| | FSD3 | 2.45 ± 0.32 | 91.1 ± 6.37 | No predicted amphipathic alpha helix |
| | FSD4 | 6.60 ± 0.84 | 86.1 ± 8.15 | Low % of hydrophobic amino acids; Low % of infrequent amino acids (Q, Y, W, P, I, S, G, V, F, E, D, C, M, N, T, H) |
| | FSD5 | 70.5 ± 6.44 | 86 ± 7.45 | — |
| | FSD6 | 1 ± 0.12 | 88.1 ± 7.66 | No predicted amphipathic alpha helix |
| | FSD7 | 78.30 ± 5.11 | 38.5 ± 3.48 | — |
| | FSD8 | 62.30 ± 5.61 | 64.8 ± 7.59 | — |
| | FSD9 | 68.21 ± 6.35 | 67.3 ± 5.19 | — |
| | FSD10 | 73.23 ± 4.94 | 79.8 ± 4.73 | — |
| | FSD11 | 68.29 ± 3.11 | 60.9 ± 7.59 | — |
| | FSD12 | 61.58 ± 5.33 | 67.8 ± 4.83 | — |
| | FSD13 | 75.94 ± 7.48 | 49.5 ± 5.13 | High hydrophobic moment |
| | FSD14 | 43.25 ± 5.35 | 92.8 ± 7.42 | — |
| | FSD15 | 54.97 ± 4.28 | 96.1 ± 2.61 | — |
| | FSD16 | 57.34 ± 4.11 | 88.2 ± 2.66 | — |
| | FSD17 | 52.83 ± 6.69 | 99.1 ± 2.09 | — |
| | FSD18 | 77.11 ± 3.25 | 82.4 +/− 4.71 | — |
| | FSD19 | 55.17 ± 4.62 | 80.6 ± 5.36 | — |
| | FSD20 | 75.23 ± 5.91 | 65.4 ± 6.18 | — |
| | FSD21 | 46.74 ± 4.03 | 75.6 ± 5.99 | — |
| | FSD22 | 45.09 ± 3.95 | 80.2 ± 7.21 | — |
| | FSD23 | 50.34 ± 4.29 | 65.3 ± 5.44 | — |
| | FSD24 | 37.48 ± 4.08 | 75.3 ± 3.93 | — |
| | FSD25 | 32.67 ± 3.17 | 71.7 ± 5.08 | — |
| | FSD26 | 47.63 ± 4.19 | 59.26 ± 1.27 | — |

"—" = No parameters outside the limits set forth in Table A1.

TABLE B3

Transduction of GFP-NLS in HeLa cells

| Cells | Peptide | Mean % cells with GFP signal (±St Dev.; n = 3) | Cell viability (%) (±St. Dev.; n = 3) | Design comments |
|---|---|---|---|---|
| HeLa | No peptide | 0.38 ± 0.02 | 100 | |
| | FSN1 | 9.14 ± 0.93 | 94.3 ± 3.07 | Low hydrophobic moment; weak amphiphilic structure |
| | FSN2 | 12.13 ± 2.06 | 91.8 ± 4.66 | Weak hydrophobic surface |
| | FSN3 | 1.86 ± 97.15 | 97.2 ± 2.03 | No predicted alpha-helical stricture |
| | FSN4 | 5.84 ± 0.49 | 90.5 ± 4.18 | >65% hydrophobic amino acids |
| | FSN5 | 13.29 ± 1.24 | 85.36 ± 6.16 | Alanine + Leucine > 40% |
| | FSN6 | 15.74 ± 1.63 | 32.63 ± 4.26 | High hydrophobic moment; difference between A/L and K/R residues is > 20% |
| | FSN7 | 3.56 ± 0.36 | 93.45 ± 3.61 | No predicted alpha-helical structure; high hydrophobic moment; 55% of infrequent residues (other than A, L, K, R) |
| | FSN8 | 3.52 ± 0.41 | 94.53 ± 3.72 | Peptide length is less than 20 |

TABLE B4

Physiochemical properties of peptides stratified by transduction score
(in HeLa cells using GFP-NLS as cargo)

| Peptide name | 1 | 2 | 3 | 4 | 5 | 6 | 7 | 8 | 9 | 10 | 11 | 12 | 13 | 14 | 15 |
|---|---|---|---|---|---|---|---|---|---|---|---|---|---|---|---|
| *Transduction scores above 4.0* | | | | | | | | | | | | | | | |
| FSD5 | 37 | Y | Y | 32 | 8.3 | 9 | 12.5 | 42 | 9.6 | 51 | 27 | 29 | 0 | 2.7 | 16.2 |
| FSD10 | 34 | Y | Y | 14.7 | 7 | 10 | 12.3 | 58.6 | 11.7 | 59 | 29.4 | 29.4 | 0 | 0 | 41.3 |
| FSD15 | 39 | Y | Y | 22.2 | 6.7 | 9 | 12 | 45.3 | 9 | 58 | 30.3 | 27.3 | 0 | 8 | 20.5 |
| FSD17 | 37 | Y | Y | 29.2 | 5.5 | 9 | 12.5 | 41.8 | 9.6 | 58 | 29 | 29 | 0 | 0 | 18.9 |
| FSD16 | 31 | Y | Y | 32 | 8.3 | 9 | 12.5 | 42 | 9.6 | 61 | 27 | 29 | 0 | 2.7 | 19.4 |
| FSD20 | 33 | Y | Y | 27.2 | 7.2 | 14 | 12.7 | 45.4 | 0 | 76 | 33.4 | 42.4 | 0 | -9 | 12 |
| FSD9 | 39 | Y | Y | 18.5 | 6.3 | 10 | 12.3 | 38.6 | 5.2 | 51 | 25.6 | 25.7 | 0 | -0.1 | 17.9 |
| FSD19 | 36 | Y | Y | 19.1 | 8.7 | 8 | 12.5 | 36.2 | 24.9 | 43 | 23.8 | 22.2 | 0 | 4.8 | 28.5 |
| FSD12 | 27 | Y | Y | 18.5 | 6.3 | 10 | 12.3 | 44.4 | 7.4 | 74 | 37 | 37 | 0 | 0 | 25.9 |
| FSD11 | 36 | Y | Y | 17.6 | 7.3 | 11 | 12.4 | 47.3 | 5.6 | 64 | 33.4 | 30.5 | 0 | 2.9 | 19.4 |
| FSD8 | 33 | Y | Y | 18.5 | 6.3 | 10 | 12.3 | 45.3 | 6 | 61 | 33.3 | 30.3 | 0 | 3 | 21.2 |
| FSD14 | 38 | Y | Y | 26.9 | 5.2 | 9 | 12.2 | 46.8 | 6.2 | 59 | 31.3 | 28.1 | 0 | 3.2 | 18.5 |
| *Transduction scores between 1.0-4.0* | | | | | | | | | | | | | | | |
| FSD13 | 40 | Y | Y | 25 | 10.3 | 10 | 12.2 | 35.1 | 8.1 | 46 | 21.6 | 24.3 | 0 | -2.7 | 20 |
| FSD22 | 32 | Y | Y | 20.9 | 7.1 | 8 | 12 | 43.6 | 9.3 | 39 | 18.4 | 25 | 0 | -2.6 | 28.6 |
| FSD21 | 31 | Y | Y | 35.7 | 9.5 | 7 | 12.5 | 45.3 | 12.9 | 39 | 16.2 | 22.6 | 0 | -6.4 | 42.1 |
| FSD23 | 31 | Y | Y | 21.6 | 8.2 | 4 | 10.9 | 38.8 | 9.6 | 43 | 24.3 | 22.6 | 0 | 5.4 | 24.3 |
| FSD7 | 33 | Y | Y | 17.2 | 8.3 | 9 | 12.4 | 48.3 | 5 | 61 | 33.3 | 27.3 | 0 | 10 | 21.2 |
| FSD24 | 34 | Y | Y | 26.5 | 8 | 5 | 9.75 | 47 | 8.7 | 50 | 29.4 | 20.6 | 5.9 | 8.8 | 32.3 |
| FSD26 | 35 | Y | Y | 28.6 | 7 | 11 | 12.3 | 60 | 11.5 | 60 | 28.5 | 31.5 | 0 | -3 | 40.1 |
| FSD25 | 35 | Y | Y | 14.3 | 7.1 | 8 | 12.2 | 48.8 | 8.6 | 63 | 37.1 | 25.7 | 2.9 | 9.7 | 20.1 |
| FSD1 | 38 | Y | Y | 23 | 7.9 | 11 | 12 | 36.8 | 2.6 | 61 | 31.6 | 28.9 | 0 | 2.7 | 7.9 |
| FSD18 | 32 | Y | Y | 25 | 8 | 9 | 12.5 | 59 | 12.6 | 52 | 28.6 | 21.9 | 0 | 5.7 | 43.8 |
| FSN5 | 39 | Y | Y | 28.3 | 12.3 | 12 | 12.7 | 48.8 | 5.2 | 74 | 43.6 | 30.8 | 0 | 12.8 | 10.4 |
| FSN2 | 31 | Y | Y | 24.3 | 1.4 | 9 | 12.5 | 35.1 | 9.6 | 51 | 27 | 29 | 0 | 2.7 | 16.2 |
| *Transduction scores between 0.5-1.0* | | | | | | | | | | | | | | | |
| FSD2 | 38 | Y | Y | 15.4 | 10.9 | 12 | 12.3 | 43.7 | 0 | 63 | 31.6 | 28.9 | 0 | 0 | 19 |
| FSN1 | 31 | N | N | 24.3 | 2.4 | 9 | 12.5 | 35.1 | 9.6 | 51 | 27 | 29 | 0 | 2.7 | 16.2 |
| FSD4 | 38 | Y | Y | 30.8 | 8.8 | 12 | 12.8 | 33.2 | 2.6 | 61 | 28.9 | 31.6 | 0 | -2.7 | 7.9 |
| FSN4 | 35 | Y | Y | 28.6 | 9.9 | 7 | 10.1 | 68.7 | 0 | 46 | 25.7 | 20 | 0 | 5.7 | 37.2 |
| FSN6 | 33 | Y | Y | 28.2 | 11.3 | 7 | 12.3 | 51.6 | 9 | 57 | 38.5 | 21.2 | 0 | 20.5 | 12.9 |
| *Transduction scores below 0.5* | | | | | | | | | | | | | | | |
| FSN7 | 31 | Y | Y | 11.1 | 11 | 8 | 12.5 | 58.2 | 16.2 | 45 | 19.4 | 25.8 | 0 | 6.4 | 55 |
| FSN8 | 19 | Y | Y | 38.8 | 4.2 | 5 | 12 | 36.9 | 0 | 47 | 21 | 26.3 | 0 | 5.3 | 26.5 |
| FSD3 | 38 | N | N | 31.7 | 1.9 | 11 | 12 | 39.5 | 0 | 61 | 31.6 | 28.9 | 0 | 7 | 7.8 |
| FSN3 | 31 | N | Y | 29.6 | 5.4 | 7 | 11.8 | 35.5 | 19.3 | 28 | 8.3 | 22.6 | 0 | -11.2 | 44.7 |
| FSD6 | 34 | N | N | 25.1 | 3.5 | 7 | 11.8 | 42.8 | 10.7 | 44 | 23.6 | 25 | 0 | 3 | 17.7 |

Y = Yes;
N = No;
Regular font = value falls within parameter range set forth in Table A1;
Bolded font- value falls outside parameter range set forth in Table A1.

The primary amino acid sequences of peptides FSD5, FSD16, FSD18, FSD19, FSD20, FSD22, and FSD23 are related, as shown in the alignment below.

```
FSD23   --LLKLWSRLLKEWTQG------RRLEAKRAEA-----

FSD19   --LLKLWSRLLKTWTQG------RRLKAKSAQASTRQA

FSD5    --LLKLWSRLLKLWTQG------RRLKAKRAKA-----

FSD18   --LLKLWSRLLKLWTQGGSGGGSGRRLKAKRAKA-----

FSD16   --LLKLWSRLLKLWTQG------RRLKAKRAKA-----

FSD20   AAVLKLWKRLLKLFRKG------RRLKAKRAKAKR---

FSD22   --VLKLWSRILKAFTQG------RRMAAKRAKCN----
```

LKLW-R-LK----G (SEQ ID NO: 158)

RR--AK-A (SEQ ID NO: 159)

Example C

Computer-Assisted Design of Synthetic Peptide Shuttle Agents

C.1 Machine-Learning-Assisted Design Approach

The peptides listed in Table C1 were designed using an algorithm described in an article by Sébastien Giguère et al. entitled "*Machine Learning Assisted Design of Highly Active Peptides for Drug Discovery*" (Giguère et al., 2014). This computational prediction method is founded on the use of algorithms based on the Kernel and machine learning methods (Shawe-Taylor J. and Cristianini N., 2004). These algorithms aim to sort peptides with maximal bioactivity depending on a biological effect of interest. Here, we considered all the peptides that we tested to date in protein transduction assays, and separated them into three distinct groups. The composition of the groups was based on a "transduction score" calculated as described in Example A. Group 1 was composed of peptides demonstrating efficient cell delivery with low toxicity; Group 2 was composed of peptides demonstrating efficient cell delivery but with elevated toxicity; and Group 3 was composed of peptides that did not demonstrate any significant polypeptide cargo transduction ability.

The scores of the peptides in each group were used as starting data points for the generation of further peptide variants. The algorithm was programmed to use the peptide sequences and the scores of the peptides of Group 1 as the positive references for the prediction of peptide variants with efficient transduction ability. The sequences and the scores of Groups 2 and 3 were included as negative controls in the algorithm to delineate the search field. The peptide variants generated by the algorithm were limited to those having a length of 35 amino acids. After running, the prediction method generated sixteen sequences (FSD27 to FSD42). After analyzing the sequences of these sixteen sequences with respect to the design parameters set forth in Table A1, only peptides FSD27, FSD34 and FSD40 satisfied all of the design parameters (see Table C2). The other peptide variants had one or more parameters outside those set forth in Table A1.

TABLE C2

FSD27 to FSD42 sequences and properties

| Peptide | Comments concerning out of limit parameter(s) with respect to Table A1 |
|---|---|
| FSD27 | No out of limit parameters. |
| FSD28 | No predicted amphiphilic alpha-helical structure |
|  | Highly hydrophobic core <12% of the total surface |
|  | Net charge below +4 (+2) |
|  | Low percentage K/R residues (11.5%) |
|  | Difference between % A/L and % K/R greater than 10% (17.1%) |
| FSD29 | No predicted amphiphilic alpha-helical structure |
|  | Highly hydrophobic core <12% of the total surface |
|  | Low hydrophobic moment (3.3) |
| FSD30 | Highly hydrophobic core <12% of the total surface |
|  | Low hydrophobic moment (2.6) |
| FSD31 | Highly hydrophobic Core <12% of the total surface |
| FSD32 | No predicted amphiphilic alpha-helical structure |
|  | Highly hydrophobic core <12% of the total surface |
| FSD33 | Highly hydrophobic core <12% of the total surface |
|  | Low hydrophobic moment (2.1) |
|  | Less than 5% leucines (2.9%) |
|  | Difference between % A/L and % K/R greater than 10% (22.9%) |
| FSD34 | No out of limit parameters. |
| FSD35 | Highly hydrophobic core <12% of the total surface |
|  | Low hydrophobic moment (2.8) |
|  | High % of A/L (48.6%) |
|  | Difference between % A/L and % K/R greater than 10% (22.8%) |
|  | Low % of total non-A/L/K/R residues (2.85%) |

TABLE C1

Machine-designed synthetic peptides and shuttle agents tested

| Peptide | SEQ ID NO: | Amino acid sequence | Length (aa) | MW (kDa) | pI | Charge |
|---|---|---|---|---|---|---|
| FSD27 | 138 | HHHHHHKWKLFWEAKLAKYARAAARQARAARQARA | 35 | 4.21 | 11.85 | 9+/1− |
| FSD28 | 139 | HHHHHHHMAHLWESNARKFWKKAFAQHAAAHIAEA | 35 | 4.18 | 9.7 | 4+/2− |
| FSD29 | 140 | LHHHSHHLIHIWLLFKLKLKKKKAARRARRARRHH | 35 | 4.43 | 12.71 | 12+/0− |
| FSD30 | 141 | HHHHHHCLLKKWEAKLAKKIGGGGRQARAKALAKA | 35 | 3.88 | 10.74 | 9+/1− |
| FSD31 | 142 | YHHHHHKWKKRWEAKLAKALRAAGRQARAKALAKA | 35 | 4.12 | 11.62 | 11+/1− |
| FSD32 | 143 | IVRHEHCMIHLWYKNLAKYCSTSHARRLARRRAHH | 35 | 4.35 | 10.92 | 8+/1− |
| FSD33 | 144 | HHHHHHHHRQRRRWEARGGFLGGGGYARAARQARA | 35 | 4.12 | 12.22 | 8+/1− |
| FSD34 | 145 | HHHHHHKLIHIWEAKLFKKIRAAARQARARRAAKA | 35 | 4.19 | 12.19 | 10+/1− |
| FSD35 | 146 | HHHHHHKLLKRWEAKLAKALAKALAKHLAKALAKA | 35 | 3.97 | 10.82 | 9+/1− |
| FSD36 | 147 | HHHHHHCLIHIWEAKLAKKCGGGGYARAAARQARA | 35 | 3.89 | 10.06 | 6+/1− |
| FSD37 | 148 | RLHHSHHLIHIWLLFKLKLKKKKRAARRARRHHHL | 35 | 4.47 | 12.71 | 12+/0− |
| FSD38 | 149 | GHHHHHHHLIHIWEAKLAKLAKALARAAARQARAK | 35 | 3.99 | 11.74 | 7+/1− |
| FSD39 | 150 | HHHHHHHRQRRRWEARGFLGGGGYARAARQARAA | 35 | 4.14 | 12.22 | 8+/1− |
| FSD40 | 151 | YGRKKRYMLRLWYQNLRMYCKKAYAQHRARQHAKL | 35 | 4.53 | 10.81 | 11+/0− |
| FSD41 | 152 | LHHHHHKLIHIWEAKLAKALAKALARRAAARQARA | 35 | 3.99 | 12.02 | 8+/1− |
| FSD42 | 153 | HHHHHHCMKVVWEIVLAKYKGGGGRARAASRRARA | 35 | 3.98 | 11.47 | 8+/1− |

Results computed using ProtParam ™ online tool available from ExPASy ™ Bioinformatics Resource Portal (http://web.expasy.org/protparam/);
pI: Isoelectric point; Charge: Total number of positively (+) and negatvely (−) charged residues

TABLE C2-continued

FSD27 to FSD42 sequences and properties

| Peptide | Comments concerning out of limit parameter(s) with respect to Table A1 |
|---|---|
| FSD36 | No predicted amphiphilic alpha-helical structure<br>Low hydrophobic moment (3.3)<br>Highly hydrophobic Core <12% of the total surface<br>Difference between % A/L and % K/R greater than 10% (11.4%) |
| FSD37 | No predicted amphiphilic alpha-helical structure |
| FSD38 | Difference between % A/L and % K/R greater than 10% (20%) |
| FSD39 | Highly hydrophobic core <12% of the total surface |
| FSD40 | No out of limit parameters. |
| FSD41 | High % of A/L (46%)<br>Difference between % A/L and % K/R greater than 10% (23%) |
| FSD42 | Less than 5% leucines (2.9%) |

HeLa cells were cultured and tested in the protein transduction assay described in Example 3.1a. GFP-NLS recombinant protein (10 μM) was co-incubated with 10 μM of the peptide and then exposed to HeLa cells for 1 min. The cells were subjected to flow cytometry analysis as described in Example 3.3. Results are shown in Table C3.

TABLE C3

Transduction of GFP-NLS in HeLa cells by machine-designed synthetic peptides

| Cells | Peptide | Mean % cells with GFP signal (±St. Dev.; n = 3) | Cell viability (%) (±St. Dev.; n = 3) |
|---|---|---|---|
| HeLa | No peptide | 0.22 ± 0.03 | 100 |
| | FSD27* | 25.49 ± 6.52 | 96.6 ± 4.94 |
| | FSD28 | 0.83 ± 0.29 | 99.4 ± 4.04 |
| | FSD29 | 6.43 ± 2.6 | 89.8 ± 8.48 |
| | FSD30 | 1.75 ± 1.14 | 99.1 ± 0.52 |
| | FSD31 | 6.90 ± 1.27 | 97.8 ± 4.22 |
| | FSD32 | 3.12 ± 1.03 | 99.2 ± 3.37 |
| | FSD33 | 0.68 ± 0.45 | 98.1 ± 1.73 |
| | FSD34* | 32.89 ± 8.9 | 97.9 ± 8.18 |
| | FSD35 | 2.08 ± 0.92 | 81.7 ± 3.45 |
| | FSD36 | 0.35 ± 0.2 | 98.9 ± 0.38 |
| | FSD37* | 11.57 ± 2.99 | 73.9 ± 2.62 |
| | FSD38 | 4.61 ± 1.33 | 98.1 ± 7.35 |
| | FSD39 | 0.23 ± 0.09 | 97.3 ± 2.07 |
| | FSD40* | 32.66 ± 0.77 | 83.9 ± 4.16 |
| | FSD41* | 36.99 ± 0.88 | 79.5 ± 0.33 |
| | FSD42 | 1.59 ± 0.39 | 97.3 ± 1.07 |

*Peptides demonstrating transduction efficiencies above 10% appear in bold.

Interestingly, the three peptides generated using the algorithm that respected all of the design parameters set forth in Table A1 (i.e., FSD27, FSD34 and FSD40) each demonstrated 25-33% transduction efficiency, with cell viabilities ranging from 83.9%-98%. The other peptides generally demonstrated transduction efficiencies below 12%, except for FSD41, which demonstrated a transduction efficiency of 37% (albeit with higher toxicity than FSD27, FSD34, and FSD40). Although only a single parameter (i.e., efficiency score) was used to program the algorithm, the results with FSD27, FSD34 and FSD40 validate the usefulness of the design parameters set forth in Table A1.

C.2 Computer-Assisted Generation of Peptide Variants

A computer-assisted design approach was employed to demonstrate the feasibility of designing and generating peptide variants that respect most or all of the design parameters set forth in Table A1. First, this approach involved manually considering and comparing the primary amino acid sequences of structurally different yet successful peptide shuttle agents to identify general consensus sequences that lead to structural parameters (2), (3) and (4) being respected (i.e., amphipathic alpha-helix formation, a positively-charged face, and a highly hydrophobic core of 12%-50%). Second, the approach involved computer-assisted random peptide sequence generation followed by descriptors filtering, implementing the consensus sequences, and one or more of the design parameters (1) and (5)-(15), in order to generate a list of peptide variants that respect nearly all of the design parameters. This is discussed in more detail below.

First, the primary amino acid sequences of peptides shown herein to have relatively high transduction efficiency scores were compared using online multiple sequence alignment tools, including CLUSTALW 2.1 (http://www.genome.jp/tools-bin/clustalw); MUltiple Sequence Comparison by Log-Expectation (MUSCLE) (https://www.ebi.ac.uk/Tools/msa/muscle/); and PRALINE (http://www.ibi.vu.nl/programs/pralinewww/). The peptides selected for comparison included the following eleven peptides: His-CM18-PTD4; EB1-PTD4; His-C(LLKK)$_3$C-PTD4; FSD5; FSD10; FSD19; FSD20; FSD21; FSD44; FSD46; and FSD63, but the analyses were not limited to only these eleven peptides. FIG. 49G shows an alignment of the eleven exemplary peptides using PRALINE, wherein the "Consistency" scores at the bottom of each aligned residue position represents the degree of conservation at that residue position (zero being the least conserved, and ten being the most conserved). For example, the alanine (A) at relative position 29 was conserved in all eleven peptides shown in FIG. 49G, and this was assigned a "Consistency" score of 10. Such multiple sequence analyses of the library of described peptides herein (and others) revealed the following general structures:

(a) [X1]-[X2]-[linker]-[X3]-[X4]  (Formula 1);

(b) [X1]-[X2]-[linker]-[X4]-[X3]  (Formula 2);

(c) [X2]-[X1]-[linker]-[X3]-[X4]  (Formula 3);

(d) [X2]-[X1]-[linker]-[X4]-[X3]  (Formula 4);

(e) [X3]-[X4]-[linker]-[X1]-[X2]  (Formula 5);

(f) [X3]-[X4]-[linker]-[X2]-[X1]  (Formula 6);

(g) [X4]-[X3]-[linker]-[X1]-[X2]  (Formula 7); or (h) [X4]-[X3]-[linker]-[X2]-[X1]  (Formula 8), where [X1], [X2], [X3], [X4], and [linker] are as defined in the table below:

TABLE C4

[X1]
2[φ]-1[+]-2[φ]-1[ζ]-1[+]-
or 2[φ]-1[+]-2[φ]-2[+]-
or 1[+]-1[φ]-1[+]-2[φ]-1[ζ]-1[+]-
or 1[+]-1[φ]-1[+]-2[φ]-2[+]-

[X2]
-2[φ]-1[+]-2[φ]-2[ζ]-
or -2[φ]-1[+]-2[φ]-2[+]-
or -2[φ]-1[+]-2[φ]-1[+]-1[ζ]-
or -2[φ]-1[+]-2[φ]-1[ζ]-1[+]-
or -2[φ]-2[+]-1[φ]-2[+]-
or -2[φ]-2[+]-1[φ]-2[ζ]-
or -2[φ]-2[+]-1[φ]-1[+]-1[ζ]-
or -2[φ]-2[+]-1[φ]-1[ζ]-1[+]-

[linker]
-G$n$-
or -S$n$-
or -(G$n$S$n$)$n$-
or -(G$n$S$n$)$n$G$n$-
or -(G$n$S$n$)$n$S$n$-
or -(G$n$S$n$)$n$G$n$(G$n$S$n$)$n$-
or -(G$n$S$n$)$n$S$n$(G$n$S$n$)$n$-

[X3]
-4[+]-A-
or -3[+]-G-A-                or -3[+]-A-A-
or -2[+]-1[φ]-1 [+]-A-       or -2[+]-1[φ]-G-A-        or -2[+]-1[φ]-A-A-
or -2[+]-A-1[+]-A            or -2[+]-A-G-A            or -2[+]-A-A-A-
or -1[φ]-3[+]-A-             or -1[φ]-2[+]-G-A-        or -1[φ]-2[+]-A-A-
or -1[φ]-1[+]-1[φ]-1[+]-A    or -1[φ]-1[+]-1[φ]-G-A    or -1[φ]-1[+]-1[φ]-A-A
or -1[φ]-1[+]-A-1[+]-A       or -1[φ]-1[+]-A-G-A       or -1[φ]-1[+]-A-A-A
or -A-1[+]-A-1[+]-A          or -A-1[+]-A-G-A          or -A-1[+]-A-A-A

[X4]
-1[ζ]-2A-1[+]-A              or -1[ζ]-2A-2[+]          or -1[+]-2A-1[+]-A
or -1[ζ]-2A-1[+]-1[ζ]-A-1[+] or -[ζ]-A-1[ζ]-A-1[+]
or -2[+]-A-2[+]              or -2[+]-A-1[+]-A
or -2[+]-A-1[+]-1[ζ]-A-1[+]  or -2[+]-1[ζ]-A-1[+]
or -1[+]-1[ζ]-A-1[+]-A       or -1[+]-1[ζ]-A-2[+]
or -1[+]-1[ζ]-A-1[+]-1[ζ]-A-1[+] or -1[+]-2[ζ]-A-1[+]
or -1[+]-S[ζ]-2[+]           or -1[+]-2[ζ]-1[+]-A
or -1[+]-2[ζ]-1[+]-1[ζ]-A-1[+] or -1[+]-2[ζ]-1[ζ]-A-1[+]
or -3[ζ]-2[+]                or -3[ζ]-1[+]-A           or -3[ζ]-1[+]-1[ζ]-A-1[+]
or -1[ζ]-2A-1[+]-A           or -1[ζ]-2A-2[+]          or -1[ζ]-2A-1[+]-1[ζ]-A-1[+]
or -2[+]-A-[+]-A             or -2[+]-1[ζ]-1[+]-A
or -1[+]-1[ζ]-A-1[+]-A       or -1[+]-2A-1[+]-1[ζ]-A-1[+]
or -1[ζ]-A-1[ζ]-A-1[+]

Wherein:
[φ] = Leu, Phe, Trp, Ile, Met, Tyr, or Val
[+] = Lys or Arg
[ζ] = Gln, Asn, Thr, or Ser
A = Ala
G = Gly
S = Ser
n = an integer from 1 to 20, 1 to 19, 1 to 18, 1 to 17, 1 to 16, 1 to 15, 1 to 14, 1 to 13, 1 to 12, 1 to 11, 1 to 10, 1 to 9, 1 to 8, 1 to 7, 1 to 6, 1 to 5, 1 to 1 to 4, or 1 to 3
The number preceding the square brackets indicate the number of contiguous residues (e.g., 3[φ] = [φ]-[φ]-[φ])
Underlined sequences indicate the most commonly occurring consensus sequences, based on the alignment shown in FIG. 49G.

Second, a script was designed and built in the programming language, Python, to randomly generate and filter sequences respecting all parameters (except for predicted isoelectric point (pI, parameter 7), because the source code to calculate this parameter was not available at the time of preparing the present example). Structural parameters 2, 3, 4 (amphipathic alpha-helix, positively-charged surface, and highly hydrophobic core) described in Table A1 were respected by entering the consensus sequences set forth in Formulas 1 to 8 and in Table C4 (appropriate alternance of Hydrophobic, Cationic, hydrophilic, Ala and Gly amino acids in the sequence) into the code, and biochemical parameters (1), (5), (6), and (8)-(15) described in Table A1 were all individually included into the code to generate 10 000 variant peptide sequences. These variant peptide sequences correspond to SEQ ID NOs: 243-10 242.

Example D

Rationally-Designed Peptides Facilitate Escape of Endosomally-Trapped Calcein

Calcein endosomal escape assays were performed as generally described in Example 2 and characterized fluorescence microscopy (data not shown) and by flow cytometry (results for FSD5 are shown below). FSD18 displayed similar results to FSD5 (data not shown).

TABLE D1

Calcein endosome escape assays

| Cells | Peptide | Peptide exposure time (min) | Peptide conc. (μM) | Mean Counts (±St. Dev.; n = 3) | Mean Factor |
|---|---|---|---|---|---|
| HeLa | No peptide | 0 | 0 | 4.94 ± 0.39 | 1.0 |
|  | FSD5 | 1 | 10 | 76.31 ± 5.18 | 15.4 |
|  |  |  | 7.5 | 56.41 ± 5.33 | 11.3 |
|  |  |  | 5 | 16.27 ± 1.27 | 3.0 |
|  |  |  | 2.5 | 12.41 ± 0.92 | 1.5 |

The result from fluorescence microscopy and flow cytometry experiments showed that rationally-designed peptide shuttle agents facilitate the escape of endosomally-trapped calcein in a dose-dependent fashion, similar to the domain-based peptide shuttle agents.

Example E

Rationally-Designed Peptides Increase Transduction Efficiency in Different Cell Types Protein transduction assays in different cell types were conducted as generally described in Example 3.1a (adherent cells) or Example 3.1b (suspension cells), using rationally-designed peptides at the indicated concentrations, 10 μM GFP-NLS as cargo, and at the indicated times, before being characterized by flow cytometry (Example 3.3) and fluorescence microscopy (Example 3.2). The results from the flow cytometry are shown in the tables below. Successful delivery of GFP-NLS to the nucleus of cells was verified by fluorescence microscopy (data not shown).

TABLE E1

GFP-NLS transduction in HeLa cells

| Cells | Peptide | Peptide conc. (μM) | Conc. of GFP-NLS (μM) | Incubation time (min) | Mean % cells with GFP signal (±St. Dev.; n = 3) | Cell viability (%) (±St. Dev.; n = 3) |
|---|---|---|---|---|---|---|
| HeLa | No peptide | 0 | 10 | 2 | 0.38 ± 0.05 | 100 |
|  | FSD5 | 10 |  | 1 | 70.5 ± 6.44 | 76 ± 7.45 |
|  |  | 8 |  | 1 | 68.5 ± 5.27 | 85 ± 6.27 |
|  |  | 5 |  | 2 | 63.1 ± 4.19 | 35.5 ± 4.82 |
|  | FSD9 | 10 |  | 1 | 73.5 ± 5.51 | 79.5 ± 6.33 |
|  |  | 8 |  | 1 | 70.2 ± 6.83 | 82.3 ± 7.16 |
|  |  | 5 |  | 2 | 58.4 ± 4.93 | 45.6 ± 3.64 |
|  | FSD10 | 10 |  | 1 | 73.1 ± 5.24 | 79.75 ± 6.37 |
|  |  | 8 |  | 1 | 55.9 ± 5.22 | 83.42 ± 6.38 |
|  |  | 5 |  | 2 | 45.8 ± 4.16 | 55.61 ± 4.28 |

TABLE E2

GFR-NLS transduction in HCC-78 cells (human non-small cell lung carcinoma)

| Cells | Peptide | Peptide conc. (μM) | Conc. of GFP-NLS (μM) | Incubation time (min) | Mean % cells with GFP signal (±St. Dev.; n = 3) | Cell viability (%) n = 3 |
|---|---|---|---|---|---|---|
| HCC-78 | No peptide | 0 | 10 | 2 | 0.21 ± 0.03 | 100 |
|  | FSD5 | 10 |  | 1 | 41.9 ± 3.61 | 15.9 ± 0.83 |
|  |  | 8 |  | 1 | 69.3 ± 5.27 | 87.7 ± 6.52 |
|  |  | 5 |  | 2 | 34.1 ± 3.57 | 75.3 ± 6.18 |
|  | FSD10 | 10 |  | 1 | 45.0 ± 4.23 | 63.1 ± 5.27 |
|  |  | 8 |  | 1 | 15.7 ± 2.67 | 76.1 ± 6.19 |
|  |  | 5 |  | 2 | 22.8 ± 3.06 | 83.1 ± 5.99 |
|  | FSD12 | 10 |  | 1 | 35.9 ± 3.18 | 46.5 ± 4.18 |
|  |  | 8 |  | 1 | 39.7 ± 4.08 | 66.3 ± 6.03 |
|  |  | 5 |  | 2 | 21.4 ± 2.53 | 75.1 ± 6.31 |

TABLE E3

GFP-NLS transduction in NCI-H196 cells (human small cell lung cancer)

| Cells | Peptide | Peptide conc. (μM) | Conc. of GFP-NLS (μM) | Incubation time (min) | Mean % cells with GFP signal (±St. Dev.; n = 3) | Cell viability (%) n = 3 |
|---|---|---|---|---|---|---|
| NCI-H196 | No peptide | 0 | 10 | 2 | 0.1 ± 0.02 | 100 |
|  | FSD5 | 10 |  | 1 | 16 ± 1.27 | 47.19 ± 3.54 |
|  |  | 8 |  | 1 | 9.1 ± 0.99 | 69.94 ± 6.38 |
|  |  | 5 |  | 2 | 7.3 ± 0.82 | 77.19 ± 6.17 |
|  | FSD10 | 10 |  | 1 | 8.3 ± 0.76 | 85.44 ± 7.66 |
|  |  | 8 |  | 1 | 7.4 ± 0.83 | 80.97 ± 8.02 |
|  |  | 5 |  | 2 | 6.4 ± 0.71 | 83.22 ± 7.51 |
|  | FSD12 | 10 |  | 1 | 6.3 ± 0.68 | 72.52 ± 6.29 |
|  |  | 8 |  | 1 | 4.5 ± 0.38 | 71.86 ± 6.44 |
|  |  | 5 |  | 2 | 5.1 ± 0.42 | 76.51 ± 6.37 |

TABLE E4

GFP-NLS transduction in THP-1 cells

| Cells | Peptide | Peptide conc. (µM) | Conc. of GFP-NLS (µM) | Incubation time (min) | Mean % cells with GFP signal (±St. Dev.; n = 3) | Cell viability (%) (±St. Dev.; n = 3) |
|---|---|---|---|---|---|---|
| THP-1 | No peptide | 0 | 10 | 1.5 | 0.27 ± 0.01 | 100 |
| | FSD10 | 1 | | 1 | 42.6 ± 4.29 | 93.5 ± 5.64 |
| | | 1 | | 1.5 | 59.4 ± 3.61 | 78.4 ± 6.15 |
| | | 2 | | 0.5 | 60.5 ± 5.27 | 96.3 ± 2.16 |
| | | 2 | | 1 | 71.9 ± 5.63 | 85.6 ± 5.22 |
| | FSD18 | 1 | | 1 | 43.6 ± 3.55 | 95.3 ± 3.11 |
| | | 1 | | 1.5 | 41.7 ± 2.82 | 86.5 ± 6.27 |
| | | 2 | | 0.5 | 53.4 ± 4.29 | 97.9 ± 1.73 |
| | | 2 | | 1 | 78.3 ± 5.48 | 98.6 ± 0.37 |
| | FSD19 | 2 | | 0.5 | 55.4 ± 4.63 | 68.7 ± 4.29 |
| | | 5 | | 0.25 | 61.5 ± 6.07 | 60.5 ± 5.71 |
| | FSD21 | 2 | | 0.5 | 47.1 ± 3.83 | 75.6 ± 6.38 |
| | | 5 | | 0.25 | 57.3 ± 4.52 | 62.5 ± 5.16 |
| | FSD25 | 2 | | 0.5 | 51.9 ± 6.39 | 79.7 ± 6.52 |
| | | 5 | | 0.25 | 51.5 ± 4.17 | 66.9 ± 5.17 |

TABLE E5

GFP-NLS transduction in various suspension cells

| Peptide | Cells | Peptide conc. (µM) | Conc. of GFP-NLS (µM) | Incubation time (min) | Mean % cells with GFP signal (±St. Dev.; n = 3) | Cell viability (%) (±St. Dev.; n = 3) |
|---|---|---|---|---|---|---|
| No peptide | [All] | 0 | 10 | 90 | 0.36 ± 0.03* | 100* |
| FSD18 | DOHH2 | 1 | | 90 | 2.4 ± 0.42 | 62.5 ± 6.17 |
| | | 2 | | 30 | 26.8 ± 2.19 | 79.8 ± 6.18 |
| | | 10 | | | 27.2 ± 2.46 | 25.0 ± 2.66 |
| | HT2 | 1 | | 90 | 12.3 ± 0.96 | 88.3 ± 7.91 |
| | | 2 | | 30 | 31.0 ± 2.55 | 80.7 ± 7.10 |
| | | 10 | | | 82.5 ± 4.07 | 63.9 ± 5.35 |
| | Jurkat | 1 | | 90 | 10.1 ± 1.11 | 98.6 ± 0.39 |
| | | 2 | | 30 | 11.0 ± 1.29 | 97.4 ± 1.09 |
| | | 10 | | | 9.9 ± 1.06 | 96.6 ± 2.46 |
| | KMS-12BM | 1 | | 90 | 13.6 ± 2.17 | 97.6 ± 1.05 |
| | | 2 | | 30 | 26.2 ± 3.93 | 95.1 ± 3.56 |
| | | 10 | | | 21.0 ± 1.76 | 92.7 ± 4.11 |
| | REC-1 | 1 | | 90 | 1.80 ± 0.88 | 96.2 ± 2.53 |
| | | 2 | | 30 | 10.9 ± 1.34 | 99.0 ± 0.39 |
| | | 10 | | | 25.0 ± 1.89 | 25.0 ± 3.17 |
| | NK | 1 | | 90 | 2.80 ± 0.33 | 99.1 ± 0.08 |
| | | 2 | | 30 | 6.41 ± 1.12 | 98.3 ± 1.00 |
| | | 5 | | 15 | 65.7 ± 5.27 | 94.9 ± 1.63 |

*Quantification of the negative control ("no peptide") was similar for all cell lines tested. Thus, the data (*) represents an average from the "no peptide" controls for at cell lines tested.

Example F

Rationally-Designed Peptide Shuttle Agents Enable Transduction of Antibodies

F.1 Transduction of Fluorescently Labeled Antibodies by FSD5 in HeLa Cells

Figure 50A:
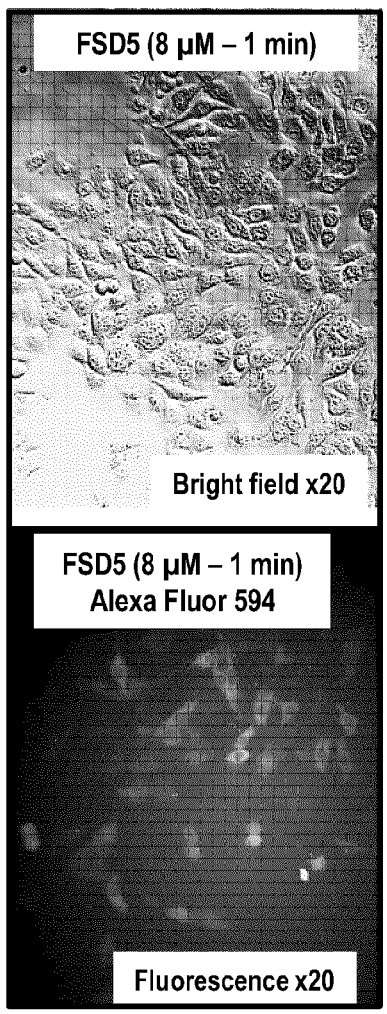
FIGS. 50A-50C show microscopy images of live HeLa cells successfully transduced by the shuttle agent FSD5 with fluorescently labelled antibodies as cargos.
Figure 50B:
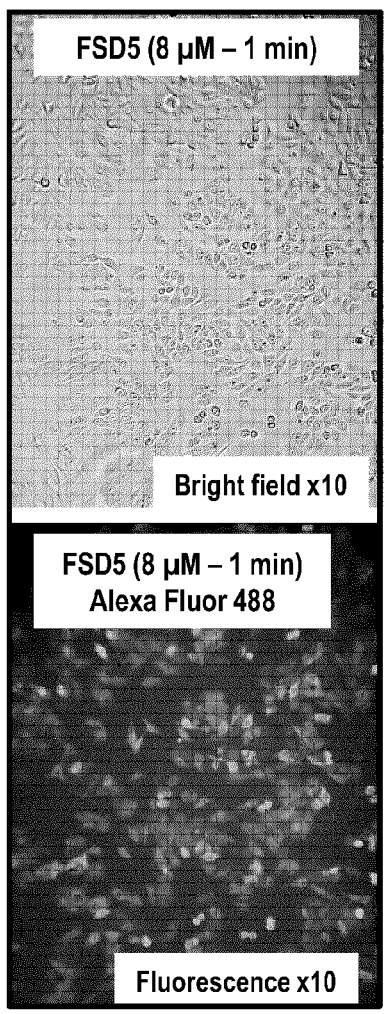
Figure 50C:
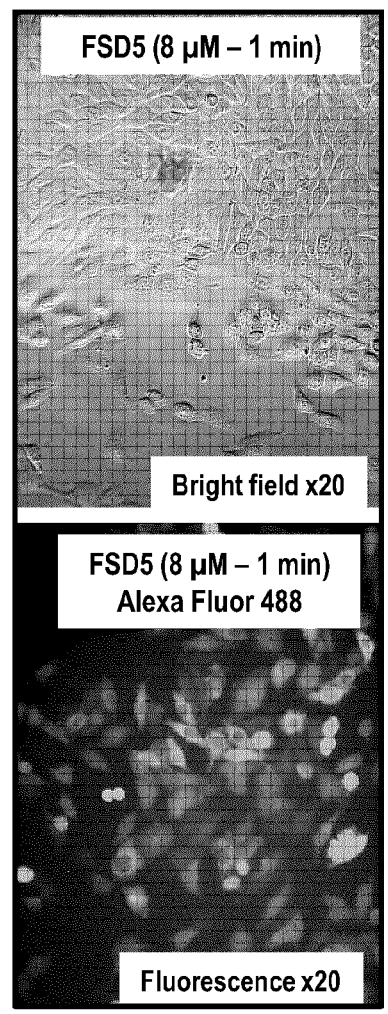

Protein transduction assays were conducted as generally described in Example 3.1, using the peptide FSD5 and an antibody as cargo after 1 min incubation time, before being characterized by fluorescence microscopy (Example 3.2). FIG. 50 shows the results of the cytoplasmic transduction of Goat Anti-Mouse IgG H&L (Alexa Fluor® 488) and Goat Anti-Rabbit IgG H&L (Alexa Fluor®594) antibodies delivered in HeLa cells by the peptide FSD5 (8 µM) for 1 min and visualized by fluorescence microscopy at 20× magnification for the Alexa Fluor 594 Ab (FIG. 50A); and at 10× and 20× magnification for the Alexa Fluor 488 Ab (FIGS. 50B and 50C, respectively). The bright field and fluorescence images of living cells are shown in upper and lower panels, respectively.

The following experiments show that other FSD peptides can also deliver functional antibodies: an anti-NUP98 antibody which labels the nuclear membrane, and two anti-Active Caspase3 antibodies that bind and inactivate the pro-apoptotic Caspase 3 protein. The delivery, microscopy and cell immune-labelling protocols are described in Example 3.

F.2 Transduction of Anti-NUP98 Antibody by FSD19 in HeLa Cells

Figure 50D:
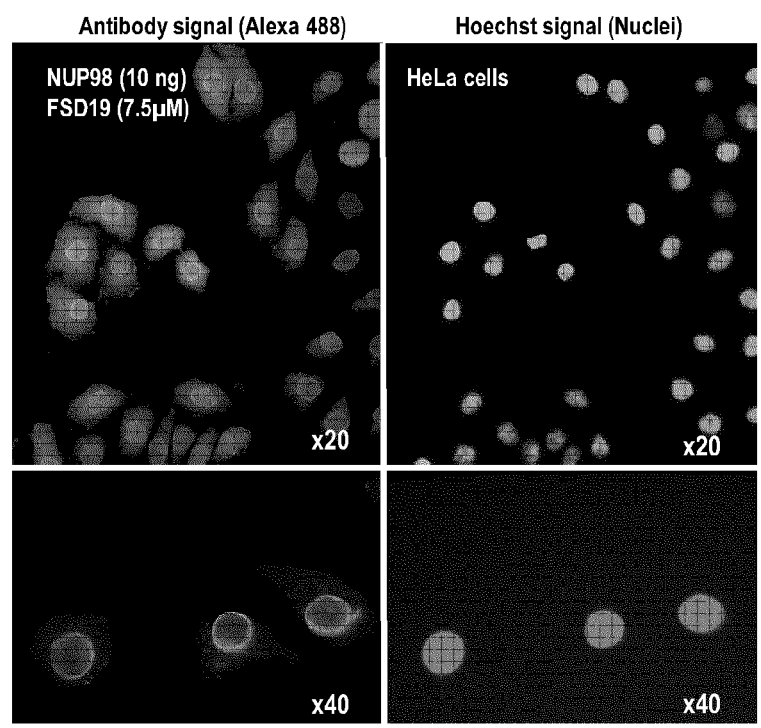
FIG. 50D shows the results of a transduction experiment in which an anti-NUP98 antibody, which recognizes an antigen in the perinuclear membrane, was transduced into HeLa cells using the shuttle agent FSD19. Following transduction, HeLa cells were fixed, permeabilized and labelled with a fluorescent (Alexa™ 488) secondary antibody recognizing the anti-NUP98 antibody (left panels) and Hoechst nuclear staining (right panels). Upper and lower panels indicate images taken under 20× and 40× magnification, respectively.

Anti-NUP98 antibody (10 µg) was co-incubated with 7.5 µM of FSD19 and exposed to HeLa cells for 4 hours. Cells are washed, fixed with paraformaldehyde 4%, permeabilized with 0.1% Triton™ and labeled with a fluorescently labeled (Alexa™ Fluor 488) goat anti-rat antibody. Antibody bound to the perinuclear membrane and cell nuclei were visualized by fluorescence microscopy at 20× (upper panels) and 40× (lower panels). As shown in FIG. 50D, green fluorescent signal emanated from the nuclear membrane (left panels) and overlapped with Hoechst staining (right panels), demonstrating that the anti-NUP98 antibody retained its functionality inside the cell following its transduction.

F.3 Transduction of Two Functional Anti-Active Caspase 3 Antibodies by FSD23 in THP-1 and Jurkat Cells: Quantification by ELISA Cleaved PARP Assay A monoclonal (mAb) and a polyclonal (pAb) anti-Active Caspase 3 antibodies (2 µg) were independently co-incubated with THP-1 and Jurkat cells for 5 min in the presence of FSD23 at 7.5 µM. The anti-apoptotic effect of each antibody was assessed via the level of Caspase 3-activated apoptosis with an ELISA cleaved PARP assay and quantified by spectrometry as described below.

The day of the experiment, cells in exponential growth phase were harvested, centrifugated (400 g for 3 min) and resuspended in serum-free RPMI in a 96-well plate (500,000 cells in 150 µL per well). Cells were centrifuged and incubated for 5 min with a mix composed by the peptide to be tested (7.5 µM) and 2 µg of the antibody to be transduced. Cells were centrifuged and resuspended in RPMI with serum in a 24-well plate for 1 h at 37° C. Actinomycin D (2 µg/mL), a cytotoxic inducer of apoptosis, was incubated with the cells for 4 h. Cells were washed with cold PBS and tested using the PARP (Cleaved) [214/215] Human ELISA Kit (ThermoFisher) according to the manufacturer's instructions followed by spectroscopy analysis. Results are shown in Table F1.

TABLE F1

Cleaved PARP ELISA assay after transduction of anti-TNF or anti-Active Caspase 3 antibody by FSD23 in THP-1 and Jurkat cells

| Cell type | Antibody | Actinomycin D | Optical Density (O.D.) PARP cleavage assay |
|---|---|---|---|
| THP-1 | anti-TNF (control) | − | 0.334 |
|  |  | + | 1.162 |
|  | anti-Active Caspase 3 mAb | − | 0.207 |
|  |  | + | 0.856 |
|  | anti-Active Caspase 3 pAb | − | 0.192 |
|  |  | + | 0.653 |
| Jurkat | anti-TNF (control) | − | 0.281 |
|  |  | + | 0.486 |
|  | anti-Active Caspase 3 mAb | − | 0.174 |
|  |  | + | 0.301 |
|  | anti-Active Caspase 3 pAb | − | 0.149 |
|  |  | + | 0.333 |

Results in THP-1 and in Jurkat cells show that FSD23 successfully transduced functional anti-Active Caspase 3 antibodies. Anti-TNF antibody was used as a non-specific negative control and actinomycin D as a cytotoxic inducer of apoptosis. In the absence of actinomycin D (−), the delivery of each anti-Active Caspase 3 mAb and pAb resulted in the reduction of the basal level of apoptosis compared to the "anti-TNF" control, in which the delivery of the anti-TNF antibody had no discernable impact on cell viability. In presence of actinomycin D ("+"), the resulting apoptosis was reduced after the delivery of both anti-Active Caspase 3 antibodies with FSD23 compared to the "anti-TNF" control.

Example G

Rationally-Designed Peptide Shuttle Agents Enable Transduction of CRISPR-Based Genome Editing Complexes We tested the ability of rationally-designed peptide shuttle agents to deliver functional CRISPR-based genome editing complexes to the nucleus of eukaryotic cells using standard DNA cleavage assays. These assays were used to measure CRISPR/Cas9 and CRISPR/Cpf1-mediated cleavage of cellular genomic DNA sequences HPRT (Hypoxanthine Phosphoribosyltransferase 1) and DNMT1 (DNA (Cytosine-5-)-Methyltransferase 1), respectively. Homologous-directed recombination (HDR) of short (72 bp) and long (1631 bp) DNA templates were performed at the HPRT genomic cut site, and measured after intracellular delivery of the genome editing complexes with different shuttle agents.

G.1 CRISPR/Cas9-NLS Complex Transduction by Rationally-Designed Peptide Shuttle Agents, Cleavage of Genomic Target Sequence, and Homologous-Directed Recombination in Different Cell Lines G.1.1 Transduction of Functional CRISPR/Cas9-NLS Complexes Cas9-NLS recombinant protein was prepared as described in Example 13.1. A mix composed of a Cas9-NLS recombinant protein and crRNA/tracrRNA (see below) targeting a nucleotide sequence of the HPTR genes were co-incubated with different concentrations of FSD5, FSD8, FSD10 or FSD18 and incubated with HeLa, HCC-78, NIC-H196 or REC-1 cells for 2 min in PBS, or 48 h in medium with serum, using the transduction protocols as generally described in Example 3.1a. Cells were then washed with PBS and harvested to proceed with the T7E1 protocol assay as described in Example 13.4.

The sequences of the crRNA and tracrRNAs constructed and their targets were:

Feldan tracrRNA [SEQ ID NO: 77]:
5'-AAACAGCAUAGCAAGUUAAAAUAAGGCUAGUCCGUUAUCAACUUGAA

AAAGUGGCACCGAGUCGGUGCU-3'

HPRT crRNA [SEQ ID NO: 103]:
5'-AAUUAUGGGGAUUACUAGGAGUUUUAGAGCUAUGCU-3'

FIGS. 51A-51F show the results of the cleavage of the targeted genomic HPRT DNA sequence with the CRISPR/Cas9 (2.5 µM) and the crRNA/tracrRNA (2 µM) in the absence ("− ctrl") or presence of the shuttle agents FSD5, FSD8, FSD10 or FSD18 used at different concentrations, exposure times, and in different types of cells: HeLa (FIGS. 51A and 51B); NK (FIG. 51C); NIC-196H (FIG. 51D); HCC-78 (FIG. 51E) and REC-1 cells (FIG. 51F), after separation by agarose gel electrophoresis. In some cases, gel lanes were loaded in duplicate. Thin dashed arrows indicate the bands corresponding to the target gene, and thicker solid arrows indicate the bands corresponding to the cleavage products of this target gene, which indicate the successful transduction of functional CRISPR/Cas9-NLS genome editing complexes. We used a Bio-Rad ImageLab™ software (Version 5.2.1, Bio-Rad, http://www.bio-rad.com/en-ca/product/image-lab-software?tab=Download) to quantify the relative signal intensities of each of the different bands directly on gels. The sum of all the bands in a given lane corresponds to 100% of the signal, and the numerical value in italics at the bottom of each lane is the sum of the relative signals (%) of only the two cleavage product bands (thicker solid arrows). No cleave product bands were found in the negative controls ("− ctrl", i.e., to cells that were exposed to CRISPR/Cas9-NLS complex in the absence of shuttle agent). These results indicate the successful delivery of the CRISPR genome-editing complexes to the nucleus, resulting in cleave of the target gene.

G.1.2 Transduction of CRISPR/Cas9-NLS Complexes with Short Linear DNA Template, Resulting in Homologous-Directed Recombination A mix was prepared containing: a Cas9-NLS recombinant protein (2.5 µM) (see Example 13.1); the crRNA/tracrRNA (2 µM) targeting a nucleotide sequence of the HPTR genes (see above); the peptide shuttle agent FSD5 (15 µM); and either 0 ng or 500 ng of a short linear template DNA (72 bp; see below).

Short DNA template [SEQ ID NO: 154]:
5'-TGAAATGGAGAGCTAAATTATGGGGATTACAAGCTTGATAGCGAAGG

GGCAGCAATGAGTTGACACTACAGA-3'

This mixture was exposed to HeLa cells for 48 h in culture media containing serum. Cells were then washed and subjected to the T7E1 assay as described in Example 13.4.

Figure 51G:
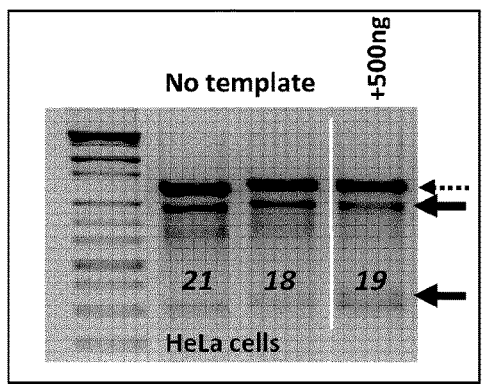
FIG. 51G shows the cleavage of the targeted HPRT genomic sequence by the CRISPR/Cas9-NLS complex transduced by FSD5, in the absence ("No template") or presence ("+500 ng") of a short DNA template (72 bp). Thin dashed arrows indicate the bands corresponding to the target gene, and thick solid arrows indicate the bands corresponding to the CRISPR/Cas9-NLS-mediated cleavage products of this target gene, which indicate the successful transduction of fully functional genome editing complexes in the presence and absence of the DNA template. The numerical value in italics at the bottom of each lane is the sum of the relative signals (%) of only the two cleavage product bands (thick solid arrows).

FIG. 51G shows the cleavage of the targeted HPRT genomic sequence by the CRISPR/Cas9 complex transduced by FSD5 (15 µM), in the absence ("No template") or presence (+500 ng) of the short DNA template. Thin dashed arrows indicate the bands corresponding to the target gene, and thicker solid arrows indicate the bands corresponding to the cleavage products of this target gene, which indicate the successful transduction of fully functional genome editing complexes. The numerical value in italics at the bottom of each lane is the sum of the relative signals (%) of only the two cleavage product bands (thicker solid arrows). These results show that FSD5 can transduce a functional CRISPR/Cas9 complex in the presence or absence of template DNA.

Figure 51H:
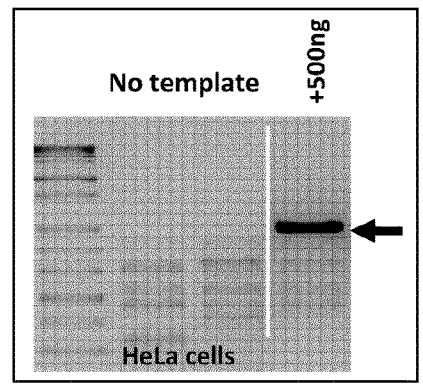
FIG. 51H shows the results of a PCR-amplification of the samples of FIG. 51G, using primers specific for the short DNA template, indicating genomic insertion of the DNA template sequence (see arrow in FIG. 51H).

To verify whether homologous-directed recombination occurred, we used the genomic DNA extracted from FSD5/CRISPR/short DNA template-treated cells to amplify the short DNA template sequence with specifically designed oligonucleotide primers targeting this sequence. The amplification of the short DNA template sequence confirmed the insertion of this template in the genome after the cutting of the HPRT gene by the CRISPR/Cas9-NLS genome editing complex. The PCR products were resolved by agarose gel electrophoresis and the results are shown in FIG. 51H. No amplification was detected in the "no template" sample, in which the genomic DNA was cut but no DNA template was provided (FIG. 51H). In contrast, an amplicon of appropriate size (FIG. 51H, thick solid line) was detected for the "+500 ng" sample, in which the genomic DNA was cut and a DNA template was provided. Detection of the amplicon indicates successful insertion of the short DNA template sequence into the genome. These results show that FSD5 can transduce CRISPR/Cas9 complex in the presence of a short DNA template, resulting in homologous-directed recombination.

G.1.3 Transduction of CRISPR/Cas9-NLS Complexes with Long Linear DNA Template, Resulting in Homologous-Directed Recombination A mix was prepared containing: a Cas9-NLS recombinant protein (2.5 µM) (see Example 13.1); the crRNA/tracrRNA (2 µM) targeting a nucleotide sequence of the HPTR genes (see above); the peptide shuttle agent FSD5 (15 µM); and either 0 ng or 500 ng of a long linear template DNA encoding GFP (1631 bp; see below).

```
GFP coding DNA template [SEQ ID NO: 156]:
5'AAGTAATCAATTACGGGGTCATTAGTTCATAGCCCATATATGGAGTTC

CGCGTTACATAACTTACGGTAAATGGCCCGCCTGGCTGACCGCCCAACGA

CCCCCGCCCATTGACGTCAATAATGACGTATGTTCCCATAGTAACGCCAA

TAGGGACTTTCCATTGACGTCAATGGGTGGAGTATTTACGGTAAACTGCC

CACTTGGCAGTACATCAAGTGTATCATATGCCAAGTACGCCCCCTATTGA

CGTCAATGACGGTAAATGGCCCGCCTGGCATTATGCCCAGTACATGACCT

TATGGGACTTTCCTACTTGGCAGTACATCTACGTATTAGTCATCGCTATT

ACCATGGTGATGCGGTTTTGGCAGTACATCAATGGGCGTGGATAGCGGTT

TGACTCACGGGGATTTCCAAGTCTCCACCCCATTGACGTCAATGGGAGTT

TGTTTTGGCACCAAAATCAACGGGACTTTCCAAAATGTCGTAACAACTCC

GCCCCATTGACGCAAATGGGCGGTAGGCGTGTACGGTGGGAGGTCTATAT

AAGCAGAGCTGGTTTAGTGAACCGTCAGATCCGCTAGCGCTACCGGTCGC
```

```
-continued
CACCATGGTGAGCAAGGGCGAGGAGCTGTTCACCGGGGTGGTGCCCATCC

TGGTCGAGCTGGACGGCGACGTAAACGGCCACAAGTTCAGCGTGTCCGGC

GAGGGCGAGGGCGATGCCACCTACGGCAAGCTGACCCTGAAGTTCATCTG

CACCACCGGCAAGCTGCCCGTGCCCTGGCCCACCCTCGTGACCACCCTGA

CCTACGGCGTGCAGTGCTTCAGCCGCTACCCCGACCACATGAAGCAGCAC

GACTTCTTCAAGTCCGCCATGCCCGAAGGCTACGTCCAGGAGCGCACCAT

CTTCTTCAAGGACGACGGCAACTACAAGACCCGCGCCGAGGTGAAGTTCG

AGGGCGACACCCTGGTGAACCGCATCGAGCTGAAGGGCATCGACTTCAAG

GAGGACGGCAACATCCTGGGGCACAAGCTGGAGTACAACTACAACAGCCA

CAACGTCTATATCATGGCCGACAAGCAGAAGAACGGCATCAAGGTGAACT

TCAAGATCCGCCACAACATCGAGGACGGCAGCGTGCAGCTCGCCGACCAC

TACCAGCAGAACACCCCCATCGGCGACGGCCCCGTGCTGCTGCCCGACAA

CCACTACCTGAGCACCCAGTCCGCCCTGAGCAAAGACCCCAACGAGAAGC

GCGATCACATGGTCCTGCTGGAGTTCGTGACCGCCGCCGGGATCACTCTC

GGCATGGACGAGCTGTACAAGTCCGGACTCAGATCTCGAGCTCAAGCTTC

GAATTCTGCAGTCGACGGTACCGCGGGCCCGGGATCCACCGGATCTAGAT

AACTGATCATAATCAGCCATACCACATTTGTAGAGGTTTTACTTGCTTTA

AAAAACCTCCCACACCTCCCCCTGAACCTGAAACATAAAATGAATGCAAT

TGTTGTTGTTAACTTGTTTATTGCAGCTTATAATGGTTACAAATAAAGCA

ATAGCATCACAAATTTCACAAATAAAGCATTTTTTTCACTGCATTCTAGT

TGTGGTTTGTCCAAACTCATCAATGTATCTTAA-3'
```

This mixture was exposed to HeLa cells for 48 h in culture media containing serum. Cells were then washed with PBS and harvested to proceed with the T7E1 protocol assay as described in Example 13.4.

Figure 51I:
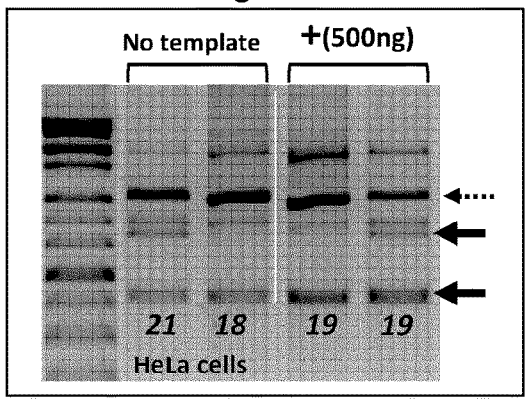
FIG. 51I shows the cleavage of the targeted HPRT genomic sequence by the CRISPR/Cas9-NLS complex transduced by FSD5, in the absence ("No template") or presence ("+500 ng") of a long linear DNA template (1631 bp). Thin dashed arrows indicate the bands corresponding to the target gene, and thick solid arrows indicate the bands corresponding to the CRISPR/Cas9-NLS-mediated cleavage products of this target gene, which indicate the successful transduction of fully functional genome editing complexes in the presence and absence of the DNA template. The numerical value in italics at the bottom of each lane is the sum of the relative signals (%) of only the two cleavage product bands (thick solid arrows).

FIG. 51I shows the cleavage of the targeted genomic HPRT genomic sequence by the CRISPR/Cas9 complex transduced by FSD5 (15 µM), in the absence ("No template") or presence ("+500 ng") of the long DNA template. The cleavage products are indicated with thick solid arrows. These results show that FSD5 can transduce a functional CRISPR/Cas9 complex in the presence or absence of a long template DNA.

Figure 51J:
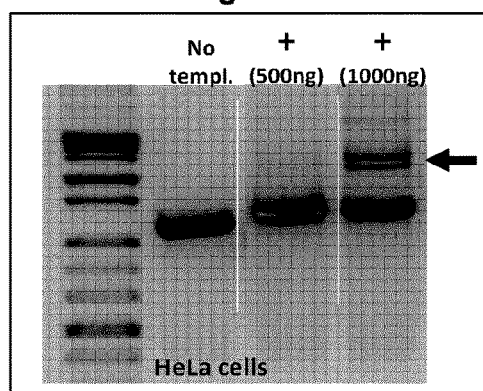
FIG. 51J shows the results of a PCR-amplification of the samples of FIG. 51I, using primers designed to amplify across the genomic cleavage site. Genomic insertion of the long DNA template sequence is visible by the presence of a larger band in the "+500 ng" (faint) and "+1000 ng" (darker) lanes—see arrow in FIG. 51J.

To verify whether homologous-directed recombination occurred, we used the genomic DNA extracted from FSD5/CRISPR/long DNA template-treated cells to amplify the long DNA template sequence with specifically designed oligonucleotide primers flanking this sequence. The amplification of the long DNA template sequence confirmed the insertion of this template in the genome after the cutting of the HPRT gene by the CRISPR/Cas9-NLS genome editing complex. The PCR products were resolved by agarose gel electrophoresis and the results are shown in FIG. 51J. In the "No template" sample, a single band corresponding to the amplicon lacking the long DNA template insertion was detected. In contrast, additional larger bands (indicated with an arrow) were detected for the "+500 ng" (faint) and "+1000 ng" (darker) samples, indicating some insertion of the long DNA template into the genomic DNA had occurred. These results show that FSD5 can transduce CRISPR/Cas9 complex in the presence of a long DNA template, resulting in homologous-directed recombination.

G.2 CRISPR/Cpf1-NLS Complex Transduction by Rationally-Designed Shuttle Agents, Cleavage of Genomic Target Sequence in HeLa and NK Cells A mix composed of a Cpf1-NLS recombinant protein (2.5 µM) and crRNA (2 µM; see below) targeting a nucleotide sequence of the DNMT1 gene was co-incubated with different concentrations of FSD18 and incubated with HeLa or NK cells for 2 min in HeLa cells, or 90 sec in NK cells in PBS or in medium without serum using transduction protocols as described in Example 3.1a.

The sequence of the Cpf1-NLS recombinant protein produced was:

[SEQ ID NO: 155]
MTQFEGFTNLYQVSKTLRFELIPQGKTLKHIQEQGFIEEDKARNDHYKEL
KPIIDRIYKTYADQCLQLVQLDWENLSAAIDSYRKEKTEETRNALIEEQA
TYRNAIHDYFIGRTDNLTDAINKRHAEIYKGLFKAELFNGKVLKQLGTVT
TTEHENALLRSFDKFTTYFSGFYENRKNVFSAEDISTAIPHRIVQDNFPK
FKENCHIFTRLITAVPSLREHFENVKKAIGIFVSTSIEEVFSFPFYNQLL
TQTQIDLYNQLLGGISREAGTEKIKGLNEVLNLAIQKNDETAHIIASLPH
RFIPLFKQILSDRNTLSFILEEFKSDEEVIQSFCKYKTLLRNENVLETAE
ALFNELNSIDLTHIFISHKKLETISSALCDHWDTLRNALYERRISELTGK
ITKSAKEKVQRSLKHEDINLQEIISAAGKELSEAFKQKTSEILSHAHAAL
DQPLPTTLKKQEEKEILKSQLDSLLGLYHLLDWFAVDESNEVDPEFSARL
TGIKLEMEPSLSFYNKARNYATKKPYSVEKFKLNFQMPTLASGWDVNKEK
NNGAILFVKNGLYYLGIMPKQKGRYKALSFEPTEKTSEGFDKMYYDYFPD
AAKMIPKCSTQLKAVTAHFQTHTTPILLSNNFIEPLEITKEIYDLNNPEK
EPKKFQTAYAKKTGDQKGYREALCKWIDFTRDFLSKYTKTTSIDLSSLRP
SSQYKDLGEYYAELNPLLYHISFQRIAEKEIMDAVETGKLYLFQIYNKDF
AKGHHGKPNLHTLYWTGLFSPENLAKTSIKLNGQAELFYRPKSRMKRMAH
RLGEKMLNKKLKDQKTPIPDTLYQELYDYVNHRLSHDLSDEARALLPNVI
TKEVSHEIIKDRRFTSDKFFFHVPITLNYQAANSPSKFNQRVNAYLKEHP
ETPIIGIDRGERNLIYITVIDSTGKILEQRSLNTIQQFDYQKKLDNREKE
RVAARQAWSVVGTIKDLKQGYLSQVIHEIVDLMIHYQAVVVLENLNFGFK
SKRTGIAEKAVYQQFEKMLIDKLNCLVLKDYPAEKVGGVLNPYQLTDQFT
SFAKMGTQSGFLFYVPAPYTSKIDPLTGFVDPFVWKTIKNHESRKHFLEG
FDFLHYDVKTGDFILHFKMNRNLSFQRGLPGFMPAWDIVFEKNETQFDAK
GTPFIAGKRIVPVIENHRFTGRYRDLYPANELIALLEEKGIVFRDGSNIL
PKLLENDDSHAIDTMVALIRSVLQMRNSNAATGEDYINSPVRDLNGVCFD
SRFQNPEWPMDADANGAYHIALKGQLLLNHLKESKDLKLQNGISNQDWLA
YIQELRNGGR<u>SSDDEATADSQHAAPPKKKRKV</u>GGSGGGSGGGSGGGRHHH

HHH (MW = 155.7 kDa; pI = 8.34)

NLS sequence is underlined

Serine/glycine rich linkers are in bold

The sequences of the crRNA used was as follows:

DNMT1 crRNA [SEQ ID NO: 157]:
5'-AAUUUCUACUGUUGUAGAUCUGAUGGUCCAUGUCUGUUACUC-3'

Figure 51K:
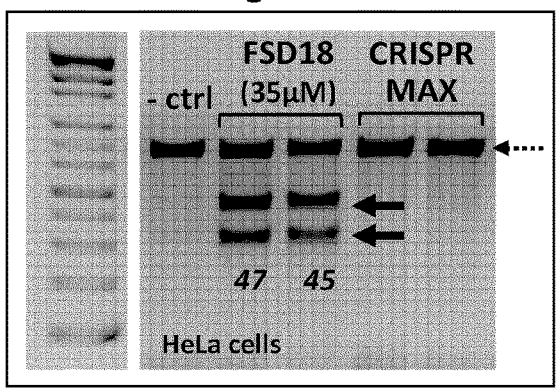
FIGS. 51K and 51L show the results of the cleavage of the targeted genomic DNMT1 DNA sequence with a CRISPR/Cpf1-NLS genome editing complex in the absence ("− ctrl") or presence of the shuttle agent FSD18 in HeLa (FIG. 51K) and NK cells (FIG. 51L), after PCR-amplification and separation by agarose gel electrophoresis. Thin dashed arrows indicate the bands corresponding to the target gene, and thick solid arrows indicate the bands corresponding to the CRISPR/Cpf1-NLS-mediated cleavage products of this target gene, which indicate the successful transduction of fully functional genome editing complexes. An imaging software was used to quantify the relative signal intensities of each of the different bands directly on gels. The sum of all the bands in a given lane corresponds to 100% of the signal, and the numerical value in italics at the bottom of each lane is the sum of the relative signals (%) of only the two cleavage product bands (thick solid arrows). No genomic DNA cleavage was observed using the lipofectamine-based transfection reagent CRISPRMAX™ to transduce the CRISPR/Cpf1-NLS genome editing complex.
Figure 51L:
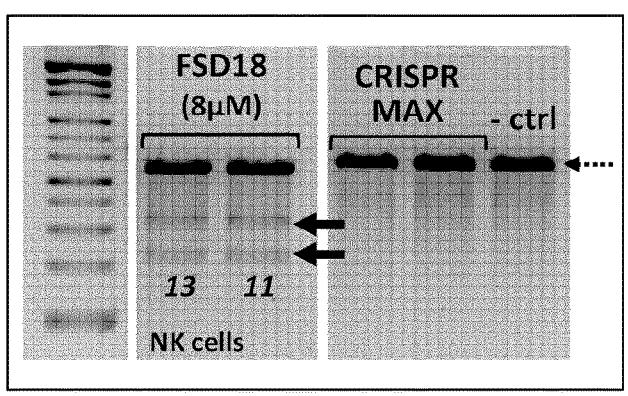

After 2 min (HeLa) or 90 sec (NK), cells were washed with PBS and harvested to proceed with the T7E1 protocol assay as described in Example 13.4. The PCR-amplified DNMT1 DNA sequence and the PCR-amplified cleavage product of this sequence were resolved on agarose gels and the results are shown in FIGS. 51K (HeLa cells) and 51L (NK cells). The negative control ("− ctrl") corresponds to cells that were exposed to CRISPR/Cpf1-NLS complex in the absence of the shuttle agent. Thin dashed arrows indicate the bands corresponding to the target gene, and thick solid arrows indicate the bands corresponding to the cleavage products of this target gene, which indicate the successful transduction of fully functional CRISPR/Cpf1-NLS genome editing complexes. The numerical value in italics at the bottom of each lane is the sum of the relative signals (%) of only the two cleavage product bands (thick solid arrows). These results show that FSD18 can transduce a functional CRISPR/Cpf1-NLS complex into the nucleus of these cells to effect cleavage of the target gene.

The CRISPRMAX™ technology is a commercially available lipofectamine-based transfection reagent optimized for CRISPR-Cas9 protein delivery. However, an equivalent reagent does not presently exist for the transduction of CRISPR-Cpf1. Interestingly, when we used the CRISPR-MAX™ reagent, it was unable to deliver the CRISPR/Cpf1-NLS complex in adherent and suspension cells. In contrast, FSD18 enabled a robust cleavage of the DNMT1 target in HeLa cells, and a lower but observable cleavage in NK cells.

These results show that the shuttle agent FSD18 successfully delivered a functional CRISPR/Cpf1-NLS complex to the nucleus of HeLa and NK cells, and that this delivery resulted in a CRISPR/Cpf1-NLS-mediated cleavage of genomic DNA.

Examples G.3-G.10

Rationally-Designed Peptide Shuttle Agents Enable Single or Multiple Gene Targeting, and/or Co-Delivery of Different CRISPR-Based Genome Editing Complexes These examples support the ability of rationally-designed peptide shuttle agents to enable the delivery and edition of multiple gene targets simultaneously. Functional CRISPR-based genome editing complexes were delivered to the nucleus of eukaryotic cells, and successful genome editing was evaluated using standard DNA cleavage assays. These assays were used to measure CRISPR/Cas9-mediated cleavage of cellular genomic DNA sequences HPRT (Hypoxanthine Phosphoribosyltransferase 1) and B2M (β2 microglobulin HLA subunit), and to measure CRISPR/Cpf1-mediated cleavage of cellular genomic DNA sequences NKG2A (Inhibitory NK cell receptor 2A), GSK3 (Glycogen Synthase Kinase 3), CBLB (E3 Ubiquitin-protein Ligase), DNMT1 (DNA (Cytosine-5-)-Methyltransferase 1) and B2M (β2 microglobulin HLA subunit). We also performed more complex genome editing approaches with the delivery of multiple CRISPR systems targeting one or two genes in the same cells. CRISPR/Cas9 and CRISPR/Cpf1 complexes were delivered together in HeLa cells to edit the HPRT and DNMT1 genes, respectively, or to edit the B2M gene in two different loci of exon 2. Finally, we co-delivered two CRISPR/Cpf1 complexes, each carrying a specific crRNA, to edit two exons in the B2M gene in NK cells.

G.3 Different Rationally-Designed Peptide Shuttle Agents Deliver CRISPR/Cas9-NLS and CRISPR/Cpf1 Complexes for B2M Gene Editing in HeLa, THP-1 and NK Cells Cas9-NLS recombinant protein was prepared as described in Example 13.1. Cpf1-NLS recombinant protein was prepared as described in Example G.2. A mix composed of a Cas9-NLS recombinant protein with its respective crRNA/tracrRNA, or a Cpf1-NLS recombinant protein with its respective single guide crRNA(s) (see below) targeting a nucleotide sequence of the B2M gene, was co-incubated with different concentrations of the peptides FSD10, FSD18, FSD19, FSD21, FSD22, or FSD23 and incubated with HeLa, THP-1 or NK cells for 90 sec in PBS, or for 1 h in medium without serum, or for 48 h in medium with serum, using the transduction protocols as generally described in Example 3.1a. Cells were then washed with PBS and harvested to proceed with the T7E1 protocol assay as described in Example 13.4.

The sequences of the crRNAs and tracrRNAs constructed and their targets were:

```
Feldan tracrRNA [SEQ ID NO: 77]:
5'-AAACAGCAUAGCAAGUUAAAAUAAGGCUAGUCCGUUAUCAACUUGAA

AAAGUGGCACCGAGUCGGUGCU-3'

Cas9-flanked B2M-crRNA [SEQ ID NO: 160]:
5'-GAGTAGCGCGAGCACAGCTAGUUUUAGAGCUAUGCUGUUUUG-3'

Cpf1-flanked B2M crRNA-1 [SEQ ID NO: 161]:
5'-AAUUUCUACUGUUGUAGAUAUCCAUCCGACAUUGAAGUU-3'

Cpf1-flanked B2M crRNA-2 [SEQ ID NO: 162]:
5'-AAUUUCUACUCUUGUAGAUCCGAUAUUCCUCAGGUACUCCA-3'
```

FIGS. 52A-52D show the results of the cleavage of the targeted genomic B2M DNA sequence after the delivery of CRISPR/Cpf1 (1.33 µM) with crRNA-1 or crRNA-2 (2 µM) in the absence ("– ctrl") or in the presence of the peptides FSD10, FSD18, FSD19, FSD21 or FSD23 used at different concentrations, exposure times, and in different types of cells: THP-1 (FIG. 52A), and NK (FIGS. 52B, 52C, 52D), after separation by agarose gel electrophoresis. FIG. 52D shows cleavage products of the genomic B2M exon 2 DNA sequence after the delivery of a CRISPR/Cpf1 complex carrying a specific single guide RNA (crRNA-1 or crRNA-2) in presence of FSD18 or FSD21, respectively. FIG. 52E shows the cleavage product of the genomic B2M exon 2 DNA sequence with CRISPR/Cas9 (2.5 µM) and crRNA (2 µM) in the absence ("– ctrl") or in the presence of the peptide FSD22 used at 10 µM for 1 h in HeLa cells, after separation by agarose gel electrophoresis. Gel lanes were loaded in duplicate. Thin dashed arrows indicate the bands corresponding to the target gene, and thick solid arrows indicate the bands corresponding to the cleavage products of this target gene, which indicate the successful transduction of fully functional CRISPR genome editing complexes. We used a Bio-Rad ImageLab™ software (Version 5.2.1, Bio-Rad, http://www.bio-rad.com/en-ca/product/image-lab-software?tab=Download) to quantify the relative signal intensities of each of the different bands directly on the gels. The sum of all the bands in a given lane corresponds to 100% of the signal, and the numerical value in italics at the bottom of each lane is the sum of the relative signals (%) of only the two cleavage product bands (thick solid arrows). No cleavage product bands were found in the negative controls ("– ctrl", i.e., to cells that were exposed to CRISPR system in the absence of FSD peptide).

These results indicate the successful delivery of the CRISPR genome-editing complexes to the nucleus, resulting in cleavage of the target gene.

G.4 Different Rationally-Designed Peptide Shuttle Agents Deliver CRISPR/Cpf1 Systems for GSK3, CBLB and DNMT1 Gene Editing in NK, THP-1 and Primary Myoblasts Cells.

Cpf1-NLS recombinant protein was prepared as described in Example G.2. A mix composed of a Cpf1-NLS recombinant protein with a single guide crRNA (see below) targeting a nucleotide sequence of the GSK3, CBLB or DNMT1 genes was co-incubated with different concentrations of FSD10, FSD18, FSD19 or FSD23 and incubated with NK cells for 48 h in medium with serum, and in THP-1 or in primary myoblasts cells for 90 sec in PBS, using the transduction protocols as generally described in Example 3.1a. Cells were then washed with PBS and harvested to proceed with the T7E1 protocol assay as described in Example 13.4.

The sequences of the crRNA constructed and their targets were:

```
GSK3 crRNA [SEQ ID NO: 163]:
5'-AAUUUCUACUCUUGUAGAUCUUUCUUCCUUUAGGAGACA-3'

CBLB crRNA [SEQ ID NO: 164]:
5'-AAUUUCUACUCUUGUAGAUAAGAACUAAAAUUCCAGAUG-3'

DNMT1 crRNA [SEQ ID NO: 157]:
5'-AAUUUCUACUGUUGUAGAUCUGAUGGUCCAUGUCUGUUACUC-3'
```

FIGS. 52F-52I show the results of the cleavage of the targeted genomic GSK3, CBLB and DNMT1 DNA sequences with the CRISPR/Cpf1 (1.33 µM) and crRNA (2 µM) in absence ("– ctrl") or presence of the shuttle agents FSD10, FSD18, FSD19 or FSD23 used at different concentrations, exposure times, and in different types of cells: NK (FIGS. 52F and 52G), THP-1 (FIG. 52H) and primary myoblasts (FIG. 52I) after separation by agarose gel electrophoresis. Gel lanes were loaded in duplicate. Thin dashed arrows indicate the bands corresponding to the target gene, and thick solid arrows indicate the bands corresponding to the cleavage products of this target gene, which indicate the successful transduction of fully functional CRISPR genome editing complexes.

G.5 Different Rationally-Designed Peptide Shuttle Agents Deliver CRISPR/Cpf1 Systems for NKG2A Gene Editing in NK Cells.

Cpf1-NLS recombinant protein was prepared as described in Example G.2. A mix composed of a Cpf1-NLS recombinant protein with a single guide crRNA (see below) targeting a nucleotide sequence of the NKG2A gene was co-incubated with different concentrations of FSD10, FSD21, FSD22 or FSD23 and incubated with NK and NK-92 cells for 90 sec in PBS, using the transduction protocols as generally described in Example 3.1a. Cells were then washed with PBS and harvested to proceed with the T7E1 protocol assay as described in Example 13.4.

The sequences of the crRNA constructed and their targets were:

```
NKG2A crRNA [SEQ ID NO: 165]:
5'-AAUUUCUACUCUUGUAGAUGGGGCAGAUUCAGGUCUGAG-3'
```

FIGS. 52J-52N show the results of the cleavage of the targeted genomic NKG2A DNA sequence with the CRISPR/Cpf1 (1.33 μM) and crRNA (2 μM) in absence ("– ctrl") or presence of the shuttle agents FSD10, FSD21, FSD22 or FSD23 used at different concentrations, exposure times, and in NK and NK-92 cells after separation by agarose gel electrophoresis. Gel lanes were loaded in duplicate. Thin dashed arrows indicate the bands corresponding to the target gene, and thick solid arrows indicate the bands corresponding to the cleavage products of this target gene, which indicate the successful transduction of fully functional CRISPR genome editing complexes.

G.6 Different Rationally-Designed Peptide Shuttle Agents Co-Deliver CRISPR/Cas9 and CRISPR/Cpf1 Complexes for HPRT, DNMT and B2M Gene Editing in HeLa and NK Cells Cas9-NLS recombinant protein was prepared as described in Example 13.1. Cpf1-NLS recombinant protein was prepared as described in Example G.2. A mix composed of Cas9-NLS recombinant protein with its respective crRNA/tracrRNA, or Cpf1-NLS recombinant protein with its respective single guide crRNA(s) (see below) targeting a nucleotide sequence of the DNMT1, HPRT and B32M genes, was co-incubated with different concentrations of FSD10, FSD18, FSD21 or FSD23, and incubated with HeLa or NK cells for 90 sec or 2 min in PBS using the transduction protocols as generally described in Example 3.1a. Cells were then washed with PBS and harvested to proceed with the T7E1 protocol assay as described in Example 13.4.

The sequences of the crRNA and tracrRNAs constructed and their targets were:

```
Feldan tracrRNA [SEQ ID NO: 77]:
5'-AAACAGCAUAGCAAGUUAAAAUAAGGCUAGUCCGUUAUCAACUUGAA

AAAGUGGCACCGAGUCGGUGCU-3'

HPRT crRNA [SEQ ID NO: 103]:
5'-AAUUAUGGGGAUUACUAGGAGUUUUAGAGCUAUGCU-3'

DNMT1 crRNA [SEQ ID NO: 157]:
5'-AAUUUCUACUGUUGUAGAUCUGAUGGUCCAUGUCUGUUACUC-3'

Cas9-flanked B2M-crRNA [SEQ ID NO: 160]:
5'-GAGUAGCGCGAGCACAGCUAGUUUUAGAGCUAUGCUGUUUUG-3'

Cpf1-flanked B2M crRNA-1 [SEQ ID NO: 161]:
5'-AAUUUCUACUGUUGUAGAUAUCCAUCCGACAUUGAAGUU-3'

Cpf1-flanked B2M crRNA-2 [SEQ ID NO: 162]:
5'-AAUUUCUACUCUUGUAGAUCCGAUAUUCCUCAGGUACUCCA-3'
```

FIGS. 53A-53C show the results of the cleavage of the targeted genomic DNMT1, HPRT and B32M DNA sequences with different CRISPR systems in the absence ("–ctrl") or in the presence of the shuttle agents FSD10, FSD18, FSD21 or FSD23 used at different concentrations, exposure times, and in HeLa and NK cells after separation by agarose gel electrophoresis. FIG. 53A shows DNMT1 (left panel) and HPRT (right panel) DNA cleavage products from the same genomic DNA extract after the co-delivery of a DNMT1-targeting CRISPR/Cpf1 (1.25 μM) complex and a HPRT-targeting CRISPR/Cas9 (1.25 μM) complex in HeLa cells. FIG. 53B shows the cleavage products of the B2M exon 2 from the same genomic DNA extract after the co-delivery of a CRISPR/Cpf1 (1.25 μM) and a CRISPR/Cas9 (1.25 μM) in HeLa cells. Each complex targeted a different locus in the B2M exon 2 via a specific crRNA flanking Cpf1 (left panel) or a specific crRNA flanking Cas9 (Right panel). FIG. 53C shows the results of the cleavage of the B2M exon 2 from genomic extracts after the co-delivery of CRISPR/Cpf1 (1.33 μM) complexes, each one carrying a specific single guide crRNA-1 or crRNA-2 (2 μM) in presence of FSD10 (upper panel), FSD21 (middle panel) or FSD23 (bottom panel). For each experiment, NK cells were exposed to CRISPR/Cpf1 with crRNA-1 or CRISPR/Cpf1 with crRNA-2, or both complexes.

G.7 Different Rationally-Designed Peptide Shuttle Agents Deliver CRISPR/Cpf1 Complexes for B2M Gene Editing in T Cells—Flow Cytometry Analysis Cpf1-NLS recombinant protein was prepared as described in Example G.2.

Unless otherwise specified, T cells used herein were obtained from healthy human blood collected in heparinized tubes. T cells were isolated using a Ficoll™ technique (Ficoll-Paque™ GE or Lymphoprep™ Stem Cell Technologies). Briefly, blood was mixed with the Ficoll™ solution in conical tubes (50 mL) and centrifuged at 2280 rpm for 20 minutes. Mononuclear cells were harvested and transferred in another conical tube (50 mL) before washing with PBS and centrifugation at 1100 rpm for 10 minutes. Cells were resuspended in 5 mL of PBS containing 20% FBS. Cells were counted and then incubated in a culture medium composed by RPMI advanced (cat: 12633012 ThermoFisher), 10% FBS, 1% Penstrep (15140122 ThermoFisher), 1% L-glutamine (25030081 ThermoFisher) IL-2 30 U/ml). Next, T cells were enriched with a Human T cell Enrichment Kit (StemCell #cat: 19051) by negative selection following the manufacturer instructions. The enriched T cells were validated using a specific anti-CD3 antibody (Biolegend #cat: 300438). At this step, collected cells were typically around 99% T cells. T cells were activated by adding IL-2 at 30 U/mL and the anti-CD28 antibody (ThermoFisher #cat: 16-0289-85) in complete medium for 5 days prior to experimentation. The activation of T cell expansion was then double-checked with both anti-CD25 and anti-CD137 antibodies.

A mix composed of a Cpf1-NLS recombinant protein with respective single guide crRNA(s) targeting a nucleotide sequence of the B2M gene was co-incubated with different concentrations of FSD21 or FSD18 peptide shuttle agents and incubated with T cells for 90 seconds in PBS using the transduction protocols as generally described in Example 3.1a. Each of the B2M crRNAs were designed to mediate CRISPR/Cpf1-based cleavage of the B2M gene, the phenotypic effects of which can be seen by the disruption of cell surface HLA, which is detectable by flow cytometry using a fluorescent APC Mouse Anti-Human HLA-ABC antibody.

The cells were then resuspended in 100 μL PBS containing 1% FBS and 4 μL of APC Mouse Anti-Human HLA-ABC antibody before an incubation period of 20 minutes, in the dark, at ambient temperature. Then, 1 mL of PBS containing 1% FBS was added to the suspension followed by a 1200 rpm centrifugation of 5 minutes. Finally, the pellet was resuspended in 100 to 200 μL of PBS containing 1% FBS before flow cytometry analysis.

Flow cytometry results based on cell size and granularity using respectively the Forward Scatter (FSC) and the Side Scatter (SSC) parameters showed that viability of the transduced T cells was not substantially affected by the co-delivery of different tested concentrations of FSD21 or FSD18 peptide shuttle agents with CRISPR/Cpf1 systems (data not shown).

Figure 54A:
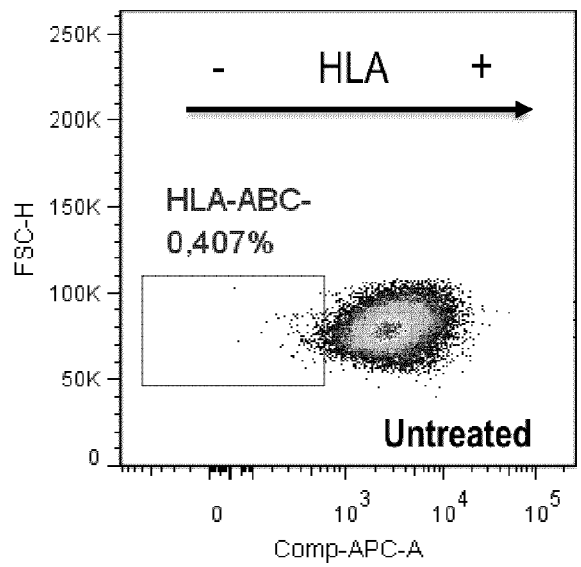
Figure 54B:
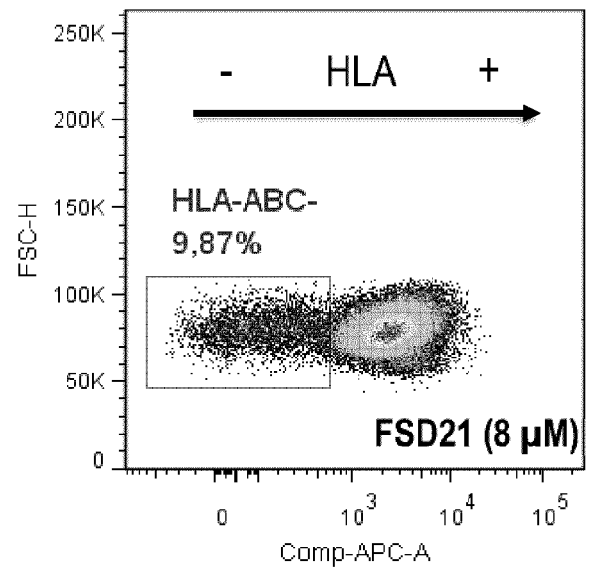
Figure 54C:
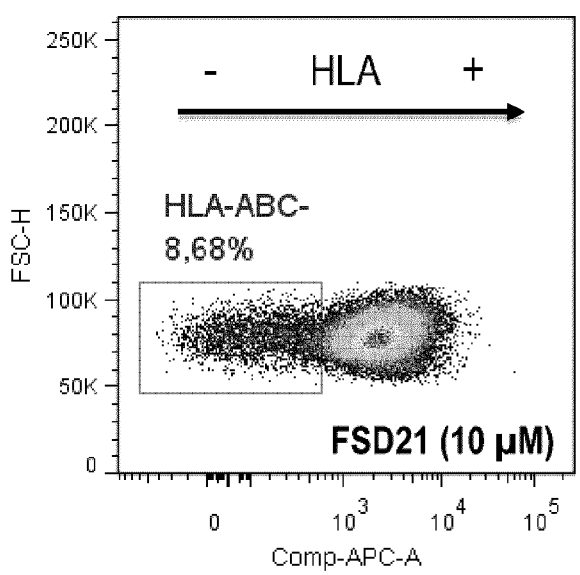
Figure 54D:
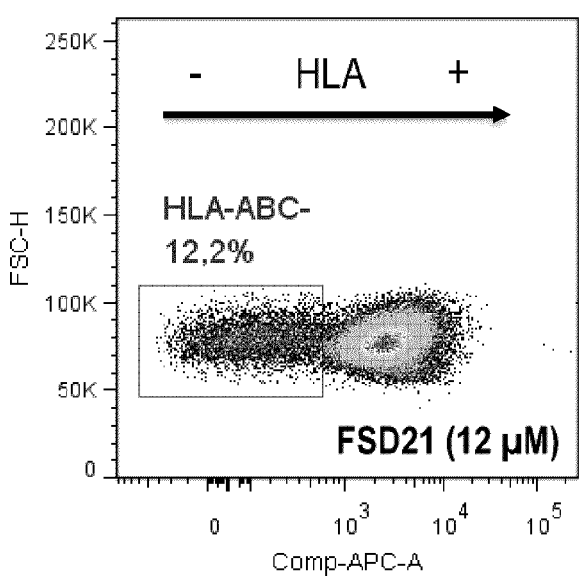
Figure 55A:
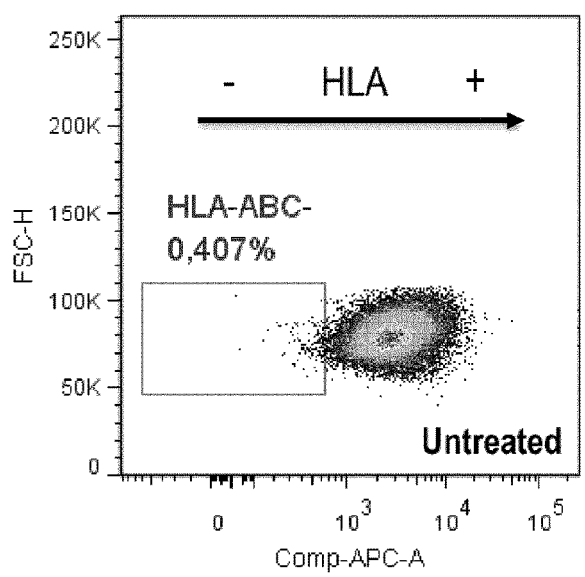
Figure 55B:
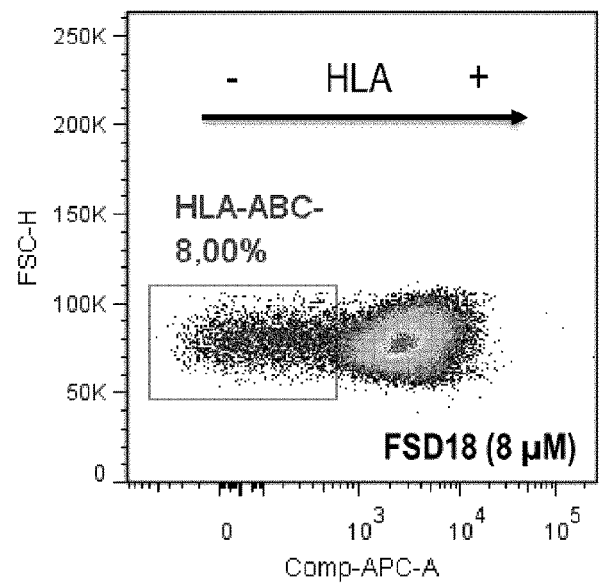
Figure 55C:
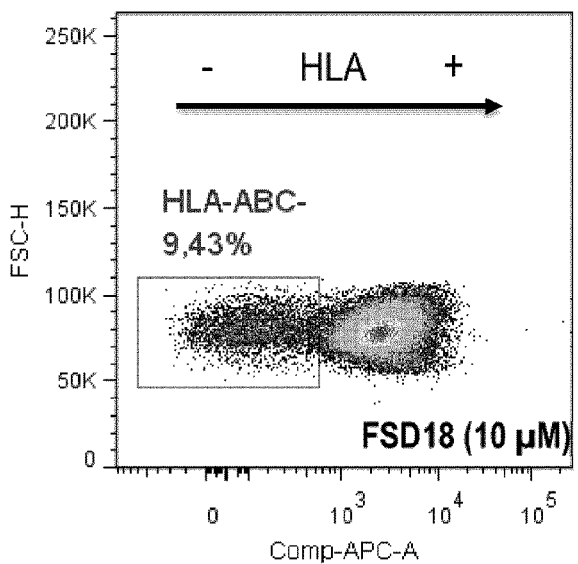
Figure 55D:
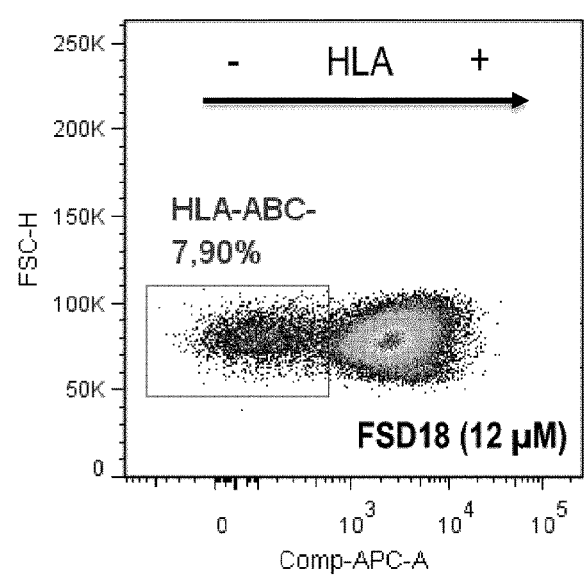

FIGS. 54A-54D and 55A-55D show delivery of CRISPR/Cpf1 genome editing complexes via the shuttle peptides FSD21 and FSD18, respectively. As seen in FIGS. 54A and 55A, "untreated" negative control cells, which were not exposed to CRISPR/Cpf1 or shuttle peptide, exhibited no significant genome editing (lack of HLA-negative cells). FIGS. 54B-54D show that FSD21 concentrations of 8, 10 and 12 μM resulted in 9.87%, 8.68%, and 12.2% of HLA-negative cells, indicating successful nuclear delivery of functional CRISPR/Cpf1 genome editing complexes and subsequent genome editing. FIGS. 55B-55D show that FSD18 concentrations of 8, 10 and 12 μM resulted in 8.0%, 9.43%, and 7.9% of HLA-negative cells, indicating successful nuclear delivery of functional CRISPR/Cpf1 genome editing complexes and subsequent genome editing.

G.8 Transduction of CRISPR/Cpf1 Complexes Containing Multiple Guide crRNA Targeting B2M in THP-1 Cell Lines Using a Single Rationally-Designed Peptide Shuttle Agent Cpf1-NLS recombinant protein was prepared as described in Example G.2. A mix composed of a Cpf1-NLS recombinant protein with a single guide crRNA (see below) targeting one of three chosen nucleotide sequences of the B2M gene was co-incubated with (3 μM) of FSD18 and incubated with THP-1 cells for 90 seconds in PBS, using the transduction protocols as generally described in Example 3.1a. The same experiments were performed using a mix composed of a Cpf1-NLS recombinant protein with three guide crRNA (see below), each targeting three different nucleotide sequences of the B2M gene. Flow cytometry experiments were performed as described in Example G.7. Also, to proceed with the T7E1 protocol assay as described in Example 13.4, cells were washed with PBS and harvested.

The sequences of the crRNA constructed and their targets were:

```
B2M crRNA-E [SEQ ID NO: 166]:
5'-AAUUUCUACUCUUGUAGAUAUCCAUCCGACAUUGAAGUU-3'

B2M crRNA-J [SEQ ID NO: 167]:
5'-AAUUUCUACUCUUGUAGAUCCGAUAUUCCUCAGGUACUCCA-3'

B2M crRNA-G [SEQ ID NO: 168]:
5'-AAUUUCUACUCUUGUAGAUUUAGAGUCUCGUGAUGUUUAAG-3'
```

Flow cytometry results based on cell size and granularity using respectively the Forward Scatter (FSC) and the Side Scatter (SSC) parameters show that the viability of the transduced THP-1 cells was not substantially affected by the presence of CRISPR/Cpf1 systems comprising the guide crRNAs (RNA-E, RNA-G, RNA-J) used separately or in combination (data not shown).

As shown in FIG. 56A, "untreated" negative control cells, which were not exposed to CRISPR/Cpf1 or shuttle peptide, exhibited no significant genome editing (lack of HLA-negative cells). FIGS. 56B-56D show that each guide crRNA (RNA-E, RNA-G, RNA-J) used separately provided comparable HLA KO efficiencies, while FIG. 56E shows the combination the three guides crRNA enhanced the HLA KO efficiency by almost a factor of two. These observations were confirmed by performing a T7E1 cleavage assay as described in Example 13.4, followed by agarose gel electrophoresis (data not shown).

G.9 Increased Cytotoxicity of NK Cells Genome-Edited to Inactive the NKG2A Gene

Genome editing was performed in NK-92 cells to evaluate whether inactivation of the endogenous NKG2A gene could increase the cytotoxicity of the NK-92 cells. Briefly, one million NK-92 cells were incubated with Cpf1-NLS (1.5 μM) gRNA complex targeting the NKG2A gene and with FSD23 (6 μM) for 90 sec. After transduction, cells were incubated in complete medium with IL-2 (20 ng/mL) for 48 h at 37° C. NK-92 cells were then immunolabelled with a phycoerythrin (PE)-labelled anti-NKG2A antibody (Miltenyi Biotec #CD159a) following the manufacturer recommendations. NK-92 cells were then analyzed with FACS and scored as a function of their anti-NKG2A detection (PE fluorescence) level and the results are shown in FIG. 57A. As controls, unlabelled wild-type NK-92 cells ("unlabelled WT cells") had no antibody signal, and labelled wild-type NK-92 cells ("labelled WT cells") had full immunolabelling signal. For NKG2A-KO NK-92 cells, two cell populations (peaks) were observed: one with a complete knock-out of NKG2A receptor expression on the cell surface ("Complete NKG2A KO cells"), and the other with a partial lack of expression ("Partial NKG2A KO cells").

To study the effect of inactivation of the NKG2A gene on the cytotoxicity of the NK-92 cells, we evaluated the ability of WT and NKG2A KO NK-92 cells to kill target HeLa cells. The NKG2A receptor encoded by the NKG2A gene in NK cells normally binds HLA-E epitopes expressed on the surface of potential target cells, which inhibits the cytotoxic activity of the NK cells (effector). To improve this effector:target cell binding, HeLa cells were treated with interferons (50 ng/mL) to increase their HLA-E cell surface expression. Prior to being exposed to effector NK-92 cells, interferon-treated HeLa cells were exposed for 45 minutes at 37° C. to Calcein-AM (ThermoFisher #C3099), a non-fluorescent, hydrophobic compound that easily permeates intact live cells. The hydrolysis of Calcein-AM by intracellular esterases produces Calcein, a hydrophilic, strongly fluorescent compound that is well-retained in the cell cytoplasm. HeLa cells with intracellular Calcein were then centrifuged and incubated in complete medium before being exposed to WT or NKG2A-KO NK cells in a 96-well plate for 4 hrs at 37° C. Killing of the target HeLa cells by effector NK cells results in release of the intracellular Calcein into the extracellular medium. The 96-well plate was then centrifuged for 5 minutes at 1250 rpm and the Calcein signal in the supernatant was analyzed by spectrophotometry with excitation at 488 nm and detection at 510 nm. Results are shown in FIG. 57B, which presents the percentage of lysis of the target HeLa cells (measured by Calcein release) as a function of different ratios of effector NK cells to target HeLa cells (E:T ratio). The results indicate that the knock out of the NKG2A receptor expression on the surface of NK-92 cells ("NK92 NKG2A-KO") increased the cytotoxic activity of the effector cells as compared to wild-type NK-92 cells ("NK92-WT"). More specifically, NKG2A-KO NK-92 effector cells killed 10-15% more target HeLa cells than WT NK-92 cells at the different effector:target ratios (E:T ratios) tested.

G.10 Different Rationally-Designed Peptide Shuttle Agents Deliver CRISPR/Cpf1 Systems for B2M and NKG2A Gene Editing in HeLa and NK-92 Cells.

Cpf1-NLS recombinant protein was prepared as described in Example G.2. A mix composed of a Cpf1-NLS recombinant protein with a single guide crRNA (see below) targeting a nucleotide sequence of the B2M or the NKG2A genes was co-incubated with 20 μM or 6 μM of the indicated peptide and incubated with HeLa or NK-92 cells, respectively, for 1 m in PBS, using the transduction protocols as generally described in Example 3.1a. Cells were then washed with PBS and harvested to proceed with the T7E1 protocol assay as described in Example 13.4.

The crRNA constructed and their targets were: B2M crRNA-G (SEQ ID NO: 168) and NKG2A crRNA (SEQ ID NO: 165).

Table G1 shows the percentage insertions and deletions (% INDELs) resulting from cleavage of the targeted genomic B2M and NKG2A DNA sequences with CRISPR/Cpf1 (1.33 μM) and crRNA (2 μM), which were transduced with the indicated peptides used at different concentrations in HeLa and NK-92 cells after T7E1 assay and direct quantification on agarose gel electrophoresis (n=2). The peptide FSD67, which failed to respect parameter (5) (low hydrophobic moment), failed to transduce CRISPR/Cpf1.

| Cells | Peptides | Gene target | % INDELs | Design parameters |
|---|---|---|---|---|
| HeLa | FSD43 | B2M | 50 | OK |
| | FSD44 | | 74 | OK |
| | FSD45 | | 45 | OK |
| | FSD46 | | 74 | OK |
| | FSD47 | | 55 | OK |
| | FSD48 | | 46 | OK |
| | FSD49 | | 27 | OK |
| | FSD50 | | 63 | OK |
| | FSD51 | | 65 | OK |
| | FSD61 | | 65 | OK |
| | FSD62 | | 65 | OK |
| | FSD63 | | 70 | OK |
| | FSD99 | | 49 | OK |
| NK-92 | FSD115 | B2M | 15 | OK |
| | FSD99 | crRNA-G | 32 | OK |
| | FSD44 | | 19 | OK |
| | FSD61 | | 23 | OK |
| | FSD63 | | 10 | OK |
| | FSD67 | | 0 | Low hydrophobic moment ($\mu H$ = 2.47) |
| | FSD68 | | 8 | No hydrophobic core |
| | FSD69 | | 23 | OK |
| | FSD70 | | 28 | OK |
| | FSD71 | | 15 | OK |
| | FSD100 | NKG2A | 16 | OK |
| | FSD101 | | 17 | OK |

OK = peptide sequence respects parameters (1)-(15).

Example H

Rationally Designed Peptide Shuttle Agents Enable Transduction of Transcription Factor HOXB4

Human HOXB4 recombinant protein (Example 14.1) was constructed, expressed and purified from a bacterial expression system as described in Example 1.4. THP-1 cells were cultured and tested in the protein transduction assay as generally described in Example 3.1b. Briefly, THP-1 cells were plated at 30 000 cells/well one day before transduction. HOXB4-WT recombinant protein (300 nM or 50 nM) was co-incubated with FSD10 or FSD18 (1 µM) and then exposed to THP-1 cells for 30 min in the presence of serum. The cells were subjected to real time-PCR analysis as described in Example 14.2 to measure the mRNA levels of a target gene as a marker for HOXB4 activity, which was then normalized to the target gene mRNA levels detected in the negative control cells (no treatment), to obtain a "Fold over control" value. Total RNA levels (ng/µL) were also measured as a marker for cell viability. Results are shown below.

TABLE H1

HOXB4-WT transduction by FSD10 and FSD18 in THP-1 cells

| Cells | Cargo/ peptide | Conc. of peptide (µM) | Conc. of HOXB4-WT (µM) | Fold over control (mean ± St. Dev) | Total RNA in ng/µL (mean ± St. Dev) |
|---|---|---|---|---|---|
| THP-1 | No treatment | 0 | 0 | 1 ± 0.1 | 172 ± 9.21 |
| | HOXB4-WT alone | | 1.5 | 2.5 ± 0.2 | 175 ± 7.05 |
| | FSD10 alone | 1 | 0 | 1.1 ± 0.14 | 181 ± 10.7 |
| | FSD18 alone | | | 1.5 ± 0.09 | 157 ± 3.9 |
| | FSD10 + HOXB4-WT | | 0.3 0.05 | 17.5 ± 0.21 15.3 ± 0.3 | 159 ± 12.5 176 ± 4.71 |
| | FSD18 + HOXB4-WT | | 0.3 0.05 | 15.8 ± 0.19 16.7 ± 15.61 | 154 ± 11.24 154 ± 3.9 |

These results show that the shuttle agents FSD10 and FSD18 are able to deliver the transcription factor HOXB4-WT to the nucleus of THP-1 cells in the presence of serum, resulting in a dose-dependent increase in mRNA transcription of the target gene.

Example I

Co-Transduction with an Independent Fluorescent Protein Marker Enables Isolation of Successfully Transduced Cells The ability of domain-based and rationally-designed peptide shuttle agents described herein to co-transduce two different polypeptide cargos simultaneously is shown in Example 9.6 (i.e., co-transduction of the fluorescent proteins GFP-NLS and mCherry-NLS) and in Example G.6 (i.e., co-transduction of the genome editing complexes CRISPR/Cas9 and CRISPR/Cpf1).

The results presented in Example I demonstrate the successful co-transduction of a fluorescent protein marker (e.g., GFP-NLS) and a genome editing complex (e.g., CRISPR/Cpf1). Surprisingly, although co-transduction with the fluorescent protein marker was not found to significantly increase overall genome-editing efficiency per se, a strikingly high proportion of cells positive for genome-engineering were positive for the fluorescent protein marker. Isolating cells positive for the fluorescent protein marker resulted in a significant increase in the proportion of successfully genome-edited cells. Furthermore, the correlation was found to be concentration specific in that cell populations exhibiting the highest fluorescence of the protein marker also exhibited the highest proportion of successful genome-editing.

I.1 Enrichment of Genome-Edited T Cells by FACS Following Co-Transduction of CRIPSR/Cpf1-NLS and GFP-NLS Cpf1-NLS recombinant protein was prepared as described in Example G.2 and GFP-NLS recombinant protein was prepared as described in Example 5.1.

Unless otherwise specified, T cells used herein were obtained from healthy human blood collected in heparinized tubes. T cells were isolated using a Ficoll™ technique (Ficoll-Paque™ GE or Lymphoprep Stem Cell Technologies). Briefly, blood was mixed with the Ficoll™ solution in conical tubes (50 mL) and centrifuged at 2280 rpm for 20 minutes. Mononuclear cells were harvested and transferred in another conical tube (50 mL) before washing with PBS and centrifugation at 1100 rpm for 10 minutes. Cells were resuspended in 5 mL of PBS containing 20% FBS. Cells were counted and then incubated in a culture medium composed by RPMI advanced (cat: 12633012 ThermoFisher), 10% FBS, 1% Penstrep (15140122 ThermoFisher), 1% L-glutamine (25030081 ThermoFisher) IL-2 30 U/ml). Next, T cells were enriched with a Human T cell Enrichment Kit (StemCell #cat: 19051) by negative selection following the manufacturer instructions. The enriched T cells were validated using a specific anti-CD3 antibody (Biolegend #cat: 300438). At this step, collected cells were typically around 99% T cells. T cells were activated by adding IL-2 at 30 U/mL and the anti-CD28 antibody (ThermoFisher #cat: 16-0289-85) in complete medium for 5 days prior to experimentation. The activation of T cell expansion was then double-checked with both anti-CD25 and anti-CD137 antibodies.

T cells were transduced with a CRISPR/Cpf1 complex comprising a guide RNA (B2M crRNA-E, SEQ ID NO: 166) designed to cleave and inactivate the B2M gene as generally described in Example G.2, resulting in the inactivation of cell surface HLA in genome-edited cells. Briefly, 4 million of activated T cells were used for each condition. In one experimental condition, cells were treated with a mix containing the peptide FSD18 at 15 µM and the CRISPR/Cpf1-NLS complex just before incubation with cells for 90 seconds. In a second experimental condition, GFP-NLS (20 µM) was added to the mix containing FSD18 at 15 µM and the CRISPR/Cpf1-NLS complex just before incubation with cells for 90 seconds. Untreated cells were used as negative control. After transduction, cells were washed and resuspended in culture media. Untreated cells and cells treated with the CRISPR/Cpf1-NLS complex were incubated in complete media for 48 hours before flow cytometry and T7E1 analysis. A first part of the cells treated with CRISPR/Cpf1-NLS and GFP-NLS complex were incubated for 48 hours in T cell medium before flow cytometry and T7E1 analysis. The second part of cells were centrifuged and resuspended in PBS with 1% serum. GFP positive (+) and GFP negative (−) cells were separated using cell sorters based on the fluorescence signal and fractions were collected and incubated for 48 hours in T cell medium before flow cytometry and T7E1 analysis.

Results are shown in FIGS. 58A-58F, in which quadrant 1 (Q1) represents cells that are HLA-positive (non-genome edited) and GFP-negative; quadrant 2 (Q2) represents cells that are HLA-positive (non-genome edited) and GFP-positive; quadrant 3 (Q3) represents cells that are HLA-negative (successfully genome edited) and GFP-positive; and quadrant 4 (Q4) represents cells that are HLA-negative (successfully genome edited) and GFP-negative. Flow cytometry results based on cell size and granularity using respectively the Forward Scatter (FSC) and the Side Scatter (SSC) parameters showed that co-delivery of GFP-NLS and CRISPR/Cpf1 systems under the tested conditions did not significantly affect the viability of the transduced T cells (data not shown).

As shown in FIG. 58A, "untreated" negative control cells not exposed to the peptide shuttle agent, GFP, nor CRISPR/Cpf1 resulted in 99% of cells in Q1 (non-genome edited, GFP-negative). FIG. 58B shows that cells exposed to the peptide FSD18 (15 µM) and CRISPR/Cpf1 in the absence of GFP-NLS resulted in 10.1% of cells in Q4—i.e., being HLA-negative (successfully genome-edited) and GFP-negative. FIG. 58C shows that cells exposed to both GFP-NLS and CRISPR/Cpf1 in the presence of the peptide FSD18, resulted in 65.7% (54.4%+11.3%) GFP-positive cells in Q2+Q3, and 11.7% (0.441%+11.3%) HLA-negative cells (successfully genome-edited) in Q3+Q4. Comparing FIGS. 58B and 58C, the presence or absence of GFP was not found to significantly increase overall genome editing efficiency (10.1% versus 11.7% of HLA-negative cells). Surprisingly, it was observed that over 96% of genome-edited cells (HLA-negative) were GFP-positive as well [FIG. 58C, Q3/(Q3+Q4)]. Fluorescence-activated cell sorting (FIG. 58D) of cells based on their GFP-fluorescence into a GFP-negative fraction (FIG. 58E) and a GFP-positive fraction (FIG. 58F) resulted in an increase in the proportion of genome-edited (HLA-negative) cells to 29.7% in the GFP-positive fraction (FIG. 58F). Strikingly, the proportion of genome-edited (HLA-negative) cells in the GFP-negative fraction (FIG. 58E) was less than 0.1%.

Each cell fraction was then subjected to the T7E1 cleavage assay as described in Example 13.4, and the different samples were subjected to agarose gel electrophoresis. The results are shown in FIG. 58G, wherein thin dashed arrows indicate the bands corresponding to the target gene, and thicker solid arrows indicate the bands corresponding to the CRISPR system-mediated cleavage products of this target gene, which indicate the successful transduction of fully functional CRISPR/Cpf1-NLS genome editing complexes. As can be seen in FIG. 58G, the GFP-positive cell fractions ("GFP+cells"; lane 4) had increased genome-editing efficiency as compared to cells before sorting ("no cell sorting"; lane 3). Peptide FSD18 and the CRISPR/Cpf1-NLS complex with GFP-NLS (lane 3) and without GFL-NLS (lane 2) showed the same genome editing level, indicating that the addition of GFP-NLS does not affect the transduction process. GFP-negative cell fractions (lane 5), and negative control ("untreated"; lane 1) demonstrated no detectable genome editing.

I.2 Further Enrichment of Genome-Edited T Cells by FACS Following Co-Transduction of CRIPSR/Cpf1-NLS and GFP-NLS The experiment described in Example 1.1 was repeated on activated T cells using 12 µM or 15 µM of the peptide FSD18. Since both concentrations of FSD18 produced similar results, only the results using 15 µM of FSD18 are shown herein. Flow cytometry results based on cell size and granularity using respectively the Forward Scatter (FSC) and the Side Scatter (SSC) parameters showed that co-delivery of GFP-NLS and CRISPR/Cpf1 systems under the tested conditions did not significantly affect the viability of the transduced T cells (data not shown).

FIGS. 59A and 59B, show the results of "untreated" negative control cells not exposed to the peptide shuttle agent, GFP, nor CRISPR/Cpf1, which were analyzed by flow cytometry for GFP fluorescence (FIG. 59A) and cell surface HLA expression (FIG. 59B). T cells were co-transduced with both GFP-NLS and CRISPR/Cpf1 via the peptide FSD18 (15 µM) and sorted based on their fluorescence signal, and cell fractions were collected and incubated for 48 hours. The resulting fraction of cells sorted for GFP fluorescence distribution is shown in FIG. 59C. The two gates in FIG. 59C indicate the fraction of cells that were considered to be GFP-positive ("GFP+"; 93.2%) and the sub-fraction of cells that were considered as exhibiting high GFP fluorescence ("GFP high"; 33.1%). Fluorescence-activated cell sorting analysis was performed to quantify the level of cell surface HLA expression in cells considered to be GFP-positive (FIG. 59D) as compared to cells considered as exhibiting high GFP fluorescence (FIG. 59E). As can be seen in FIG. 59D, 21.8% of GFP-positive cells were HLA-negative (successfully genome-edited), whereas this value rose to a striking 41.6% amongst cells exhibiting high GFP fluorescence (FIG. 59E). Thus, the proportion of successfully genome-edited (HLA-negative) cells increased with the fluorescence level of the fluorescent protein marker (GFP-NLS).

The above co-transduction experiment was repeated using 12 µM or 15 µM FSD18, followed by fluorescence-activated cell sorting into GFP-positive and GFP-negative cell fractions. Each fraction was subjected to the T7E1 cleavage assay as described in Example 13.4, and the different samples were subjected to agarose gel electrophoresis. Consistent with the results of the flow cytometry experiments described above, the results from T7E1 cleavage assays showed that the GFP-positive cell fractions had increased genome-editing efficiency as compared to in the GFP-negative cell fractions (data not shown).

I.3 Enrichment of Genome-Edited THP-1 Cells by FACS Following Co-Transduction of CRIPSR/Cpf1-NLS and GFP-NLS The experiments performed in Examples I.1 and I.2 were reproduced in THP-1 cells with similar results. Co-transduction of CRIPSR/Cpf1-NLS and GFP-NLS in the presence 2 µM FSD18, followed by fluorescence-activated cell sorting of GFP-positive cells resulted in a significant enrichment of genome edited cells (data not shown).

I.4 Successful Subsequent Transduction of Previously Sorted GFP-Negative Cells

This example shows that untransduced cells following a first round of transduction with a peptide shuttle agent are not necessarily refractory to subsequent transductions.

T cells obtained as described in Example 1.1 were subjected to a first transduction by co-incubation of FSD18 (10 µM) and GFP-NLS (20 µM) for 90 sec before washing and incubation at 37° C. The "untreated" negative control cells showed no GFP signal (FIG. 60A). Cell sorting was performed 18 h after GFP-NLS transduction. GFP-positive and GFP-negative cells were separated using cell sorters based on the fluorescence signal (see FIG. 60B), and GFP-negative cells were harvested and isolated (see FIG. 60C). A second GFP-NLS transduction was performed on the GFP-negative T cell population using the same protocol as the first transduction. GFP-NLS transduction was analyzed by flow cytometry as previously described 18 h later and GFP-positive cells were scored by flow cytometry. The results from this second transduction are shown in FIG. 60D, in which the GFP-NLS transduction efficiency was found to be 60.6%.

These results indicate that untransduced cells following a first round of transduction with a peptide shuttle agent are not necessarily refractory to subsequent transductions, and that overall transduction efficiency in a starting cell population may be increased by repeated successive transduction experiments on the untransduced cell fraction. This method of repeated successive transduction experiments, along with the co-transduction results presented in Examples I.1, I.2 and I.3, suggest an attractive method for increasing genome editing efficiency in valuable cell populations (e.g., patient-derived cells for cell therapy), and/or in cell populations that are inherently more difficult to transduce.

REFERENCES

Andreu, D., Ubach, J., Boman, A., Wahlin, B., Wade, D., Merrifield, R. B., and Boman, H. G. (1992) Shortened cecropin A-melittin hybrids. Significant size reduction retains potent antibiotic activity. FEBS letters 296, 190-194

Aguila, J. R., W. Liao, J. Yang, C. Avila, N. Hagag, L. Senzel and Y. Ma (2011). "SALL4 is a robust stimulator for the expansion of hematopoietic stem cells." Blood 118(3): 576-585.

Akinci, E., A. Banga, L. V. Greder, J. R. Dutton and J. M. Slack (2012). "Reprogramming of pancreatic exocrine cells towards a beta (beta) cell character using Pdx1, Ngn3 and MafA." Biochem J 442(3): 539-550.

Alford et al., (2009). "Toxicity of organic fluorophores used in molecular imaging: literature review." Mol Imaging. 8(6):341-54.

Amand, H. L., B. Norden and K. Fant (2012). "Functionalization with C-terminal cysteine enhances transfection efficiency of cell-penetrating peptides through dimer formation." Biochem Biophys Res Commun 418(3): 469-474.

Aoukaty, A. & Tan, R. (2005). Role for glycogen synthase kinase-3 in NK cell cytotoxicity and X-linked lymphoproliferative disease. J Immunol 174, 4551-8.

Barrangou, R. and Luciano A. Marraffini (2014). "CRISPR-Cas Systems: Prokaryotes Upgrade to Adaptive Immunity". Cell Volume 54, Issue 2, p 234-244, 24 Apr. 2014.

Bejarano, L. A. and C. Gonzalez (1999). "Motif trap: a rapid method to clone motifs that can target proteins to defined subcellular localisations." J Cell Sci 112 (Pt 23): 4207-4211.

Bikard et al., Programmable repression and activation of bacterial gene expression using an engineered CRISPR-Cas system. Nucleic Acids Res. 41, 7429-7437.

Boman, H. G., Wade, D., Boman, I. A., Wahlin, B., and Merrifield, R. B. (1989) Antibacterial and antimalarial properties of peptides that are cecropin-melittin hybrids. FEBS letters 259, 103-106.

Braud, V. M., Allan, D. S., O'Callaghan, C. A., Soderstrom, K., D'Andrea, A., Ogg, G. S., Lazetic, S., Young, N. T., Bell, J. I., Phillips, J. H., Lanier, L. L. & McMichael, A. J. (1998). HLA-E binds to natural killer cell receptors CD94/NKG2A, B and C. Nature 391, 795-9.

Buganim et al., (2014) "The Developmental Potential of iPSCs Is Greatly Influenced by Reprogramming Factor Selection". Cell stem cell. 15, 295-309.

Burstein et al., (2017), "New CRISPR-Cas systems from uncultivated microbes." Nature. 542(7640):237-241.

Chan, C. K. and D. A. Jans (1999). "Enhancement of polylysine-mediated transferrinfection by nuclear localization sequences: polylysine does not function as a nuclear localization sequence." Hum Gene Ther 10(10): 1695-1702.

Chan, C. K. and D. A. Jans (2001). "Enhancement of MSH receptor- and GAL4-mediated gene transfer by switching the nuclear import pathway." Gene Ther 8(2): 166-171.

Cong et al., (2013). Multiplex genome engineering using CRISPR/Cas systems. Science 339, 819-823.

Cooper, M. A., Fehniger, T. A. & Caligiuri, M. A. (2001). The biology of human natural killer-cell subsets. Trends Immunol 22, 633-40.

Cox et al. (2015). "Therapeutic genome editing: prospects and challenges". Nature medicine, 21: 121-131.

de Kruijf, E. M., Sajet, A., van Nes, J. G., Natanov, R., Putter, H., Smit, V. T., Liefers, G. J., van den Elsen, P. J., van de Velde, C. J. & Kuppen, P. J. (2010). HLA-E and HLA-G expression in classical HLA class I-negative tumors is of prognostic value for clinical outcome of early breast cancer patients. J Immunol 185, 7452-9.

Delconte, R. B., Kolesnik, T. B., Dagley, L. F., Rautela, J., Shi, W., Putz, E. M., Stannard, K., Zhang, J. G., Teh, C., Firth, M., Ushiki, T., Andoniou, C. E., Degli-Esposti, M. A., Sharp, P. P., Sanvitale, C. E., Infusini, G., Liau, N. P., Linossi, E. M., Burns, C. J., Carotta, S., Gray, D. H., Seillet, C., Hutchinson, D. S., Belz, G. T., Webb, A. I., Alexander, W. S., Li, S. S., Bullock, A. N., Babon, J. J., Smyth, M. J., Nicholson, S. E. & Huntington, N. D. (2016). CIS is a potent checkpoint in NK cell-mediated tumor immunity. Nat Immunol 17, 816-24.

Denman, C. J., Senyukov, V. V., Somanchi, S. S., Phatarpekar, P. V., Kopp, L. M., Johnson, J. L., Singh, H., Hurton, L., Maiti, S. N., Huls, M. H., Champlin, R. E., Cooper, L. J. & Lee, D. A. (2012). Membrane-bound IL-21 promotes sustained ex vivo proliferation of human natural killer cells. PLoS ONE 7, e30264.

Dolfini, D., M. Minuzzo, G. Pavesi and R. Mantovani (2012). "The short isoform of NF-YA belongs to the embryonic stem cell transcription factor circuitry." Stem Cells 30(11): 2450-2459.

Drin, G., S. Cottin, E. Blanc, A. R. Rees and J. Temsamani (2003). "Studies on the internalization mechanism of cationic cell-penetrating peptides." J Biol Chem 278(33): 31192-31201.

Eisenberg et al., (1982). "The helical hydrophobic moment: a measure of the amphiphilicity of a helix". Nature 299, 371-374.

El-Andaloussi, S., H. J. Johansson, T. Holm and U. Langel (2007). "A novel cell-penetrating peptide, M918, for efficient delivery of proteins and peptide nucleic acids." Mol Ther 15(10): 1820-1826.

El-Sayed, A., S. Futaki and H. Harashima (2009). "Delivery of macromolecules using arginine-rich cell-penetrating peptides: ways to overcome endosomal entrapment." AAPS J 11(1): 13-22.

Elmquist, A., M. Lindgren, T. Bartfai and U. Langel (2001). "VE-cadherin-derived cell-penetrating peptide, pVEC, with carrier functions." Exp Cell Res 269(2): 237-244.

Erazo-Oliveras et al., (2014) "Protein delivery into live cells by incubation with an endosomolytic agent." Nat Methods. (8):861-7.

Fanara, P., M. R. Hodel, A. H. Corbett and A. E. Hodel (2000). "Quantitative analysis of nuclear localization signal (NLS)-importin alpha interaction through fluorescence depolarization. Evidence for auto-inhibitory regulation of NLS binding." J Biol Chem 275(28): 21218-21223.

Fasoli A et al., (2014) "Mechanistic insight into CM18-Tat11 peptide membrane-perturbing action by whole-cell patch-clamp recording." Molecules. 19(7):9228-39.

Fawell, S., J. Seery, Y. Daikh, C. Moore, L. L. Chen, B. Pepinsky and J. Barsoum (1994). "Tat-mediated delivery of heterologous proteins into cells." Proc Natl Acad Sci USA 91(2): 664-668.

Fominaya, J., C. Uherek and W. Wels (1998). "A chimeric fusion protein containing transforming growth factor-alpha mediates gene transfer via binding to the EGF receptor." Gene Ther 5(4): 521-530.

Fominaya, J. and W. Wels (1996). "Target cell-specific DNA transfer mediated by a chimeric multidomain protein. Novel non-viral gene delivery system." J Biol Chem 271(18): 10560-10568.

Fonoudi, H., M. Yeganeh, F. Fattahi, Z. Ghazizadeh, H. Rassouli, M. Alikhani, B. A. Mojarad, H. Baharvand, G. H. Salekdeh and N. Aghdami (2013). "ISL1 protein transduction promotes cardiomyocyte differentiation from human embryonic stem cells." PLoS One 8(1): e55577.

Gao et al., (2016) DNA-guided genome editing using the *Natronobacterium gregoryi* Argonaute. Nature Biotechnology 34, 768-773.

Giguère et al., Machine learning assisted design of highly active peptides for drug discovery. PLoS Comput Biol. 2015 Apr. 7; 11(4):e1004074.

Gilbert et al., CRISPR-mediated modular RNA-guided regulation of transcription in eukaryotes. Cell 154, 442-451.

Gilmore, T. D. and H. M. Temin (1988). "v-rel oncoproteins in the nucleus and in the cytoplasm transform chicken spleen cells." J Virol 62(3): 703-714.

Glover, D. J., S. M. Ng, A. Mechler, L. L. Martin and D. A. Jans (2009). "Multifunctional protein nanocarriers for targeted nuclear gene delivery in nondividing cells." FASEB J 23(9): 2996-3006.

Gordon, S. M., J. Chaix, L. J. Rupp, J. Wu, S. Madera, J. C. Sun, T. Lindsten and S. L. Reiner (2012). "The transcription factors T-bet and Eomes control key checkpoints of natural killer cell maturation." Immunity 36(1): 55-67.

Gottschalk, S., J. T. Sparrow, J. Hauer, M. P. Mims, F. E. Leland, S. L. Woo and L. C. Smith (1996). "A novel DNA-peptide complex for efficient gene transfer and expression in mammalian cells." Gene Ther 3(5): 448-457.

Gould, S. J., G. A. Keller, N. Hosken, J. Wilkinson and S. Subramani (1989). "A conserved tripeptide sorts proteins to peroxisomes." J Cell Biol 108(5): 1657-1664.

Green, M. and P. M. Loewenstein (1988). "Autonomous functional domains of chemically synthesized human immunodeficiency virus tat trans-activator protein." Cell 55(6): 1179-1188.

Grimes, M. L., J. Zhou, E. C. Beattie, E. C. Yuen, D. E. Hall, J. S. Valletta, K. S. Topp, J. H. LaVail, N. W. Bunnett and W. C. Mobley (1996). "Endocytosis of activated TrkA: evidence that nerve growth factor induces formation of signaling endosomes." J Neurosci 16(24): 7950-7964.

Guo, Z. Y., Lv, Y. G., Wang, L., Shi, S. J., Yang, F., Zheng, G. X., Wen, W. H. & Yang, A. G. (2015). Predictive value of HLA-G and HLA-E in the prognosis of colorectal cancer patients. Cell Immunol 293, 10-6.

Hallbrink, M., A. Floren, A. Elmquist, M. Pooga, T. Bartfai and U. Langel (2001). "Cargo delivery kinetics of cell-penetrating peptides." Biochim Biophys Acta 1515(2): 101-109.

Herce, H. D. and A. E. Garcia (2007). "Molecular dynamics simulations suggest a mechanism for translocation of the HIV-1 TAT peptide across lipid membranes." Proc Natl Acad Sci USA 104(52): 20805-20810.

Ho et al., (2001). "Synthetic protein transduction domains: enhanced transduction potential in vivo." Cancer Research 61: 474-477.

Horng, T., Bezbradica, J. S. & Medzhitov, R. (2007). NKG2D signaling is coupled to the interleukin 15 receptor signaling pathway. Nat Immunol 8, 1345-52.

Hurt, E. C., B. Pesold-Hurt, K. Suda, W. Oppliger and G. Schatz (1985). "The first twelve amino acids (less than half of the pre-sequence) of an imported mitochondrial protein can direct mouse cytosolic dihydrofolate reductase into the yeast mitochondrial matrix." EMBO J 4(8): 2061-2068.

Ichii, H., A. Sakamoto, Y. Kuroda and T. Tokuhisa (2004). "Bcl6 acts as an amplifier for the generation and proliferative capacity of central memory CD8+ T cells." J Immunol 173(2): 883-891.

Irie, Y., K. Yamagata, Y. Gan, K. Miyamoto, E. Do, C. H. Kuo, E. Taira and N. Miki (2000). "Molecular cloning and characterization of Amida, a novel protein which interacts with a neuron-specific immediate early gene product arc, contains novel nuclear localization signals, and causes cell death in cultured cells." J Biol Chem 275(4): 2647-2653.

Ishigami, S., Arigami, T., Okumura, H., Uchikado, Y., Kita, Y., Kurahara, H., Maemura, K., Kijima, Y., Ishihara, Y., Sasaki, K., Uenosono, Y. & Natsugoe, S. (2015). Human leukocyte antigen (HLA)-E and HLA-F expression in gastric cancer. Anticancer Res 35, 2279-85.

Kakudo, T., S. Chaki, S. Futaki, I. Nakase, K. Akaji, T. Kawakami, K. Maruyama, H. Kamiya and H. Harashima (2004). "Transferrin-modified liposomes equipped with a pH-sensitive fusogenic peptide: an artificial viral-like delivery system." Biochemistry 43(19): 5618-5628.

Karniely, S. and O. Pines (2005). "Single translation-dual destination: mechanisms of dual protein targeting in eukaryotes." EMBO Rep 6(5): 420-425.

Kato, G. J., W. M. Lee, L. L. Chen and C. V. Dang (1992). "Max: functional domains and interaction with c-Myc." Genes Dev 6(1): 81-92.

Kichler, A., A. J. Mason and B. Bechinger (2006). "Cationic amphipathic histidine-rich peptides for gene delivery." Biochim Biophys Acta 1758(3): 301-307.

Kichler et al., (2003). "Histidine-rich amphipathic peptide antibiotics promote efficient delivery of DNA into mammalian cells". Proc Natl Acad Sci USA. 2003 Feb. 18; 100(4): 1564-1568.

Kira et al., (2011). "Unification of Cas protein families and a simple scenario for the origin and evolution of CRISPR-Cas systems". Biol Direct. 2011; 6: 38.

Kirwan, S. E. & Burshtyn, D. N. (2005). Killer cell Ig-like receptor-dependent signaling by Ig-like transcript 2 (ILT2/CD85j/LILRB1/LIR-1). J Immunol 175, 5006-15.

Kleinschmidt, J. A. and A. Seiter (1988). "Identification of domains involved in nuclear uptake and histone binding of protein N1 of *Xenopus laevis*." EMBO J 7(6): 1605-1614.

Kohler, M., D. Gorlich, E. Hartmann and J. Franke (2001). "Adenoviral E1A protein nuclear import is preferentially mediated by importin alpha3 in vitro." Virology 289(2): 186-191.

Kwon, et al., (2010). "A Truncated HGP Peptide Sequence That Retains Endosomolytic Activity and Improves Gene Delivery Efficiencies". Mol. Pharmaceutics, 7:1260-65.

Lamiable et al., (2016). "PEP-FOLD3: faster de novo structure prediction for linear peptides in solution and in complex" Nucleic Acids Res. 44(W1):W449-54.

Lanford, R. E., P. Kanda and R. C. Kennedy (1986). "Induction of nuclear transport with a synthetic peptide homologous to the SV40 T antigen transport signal." Cell 46(4): 575-582.

Lee, N., Llano, M., Carretero, M., Ishitani, A., Navarro, F., Lopez-Botet, M. & Geraghty, D. E. (1998). HLA-E is a major ligand for the natural killer inhibitory receptor CD94/NKG2A. Proc Natl Acad Sci USA 95, 5199-204.

Levy, E. M., Bianchini, M., Von Euw, E. M., Barrio, M. M., Bravo, A. I., Furman, D., Domenichini, E., Macagno, C., Pinsky, V., Zucchini, C., Valvassori, L. & Mordoh, J. (2008). Human leukocyte antigen-E protein is overexpressed in primary human colorectal cancer. Int J Oncol 32, 633-41.

Li, W., F. Nicol and F. C. Szoka, Jr. (2004). "GALA: a designed synthetic pH-responsive amphipathic peptide with applications in drug and gene delivery." Adv Drug Deliv Rev 56(7): 967-985.

Lin, M. H., F. C. Chou, L. T. Yeh, S. H. Fu, H. Y. Chiou, K. I. Lin, D. M. Chang and H. K. Sytwu (2013). "B lymphocyte-induced maturation protein 1 (BLIMP-1) attenuates autoimmune diabetes in NOD mice by suppressing Th1 and Th17 cells." Diabetologia 56(1): 136-146.

Liu, X., P. K. Tian, D. W. Ju, M. H. Zhang, M. Yao, X. T. Cao and J. R. Gu (2003). "Systemic genetic transfer of p21WAF-1 and GM-CSF utilizing of a novel oligopeptide-based EGF receptor targeting polyplex." Cancer Gene Ther 10(7): 529-539.

Loeser, S., Loser, K., Bijker, M. S., Rangachari, M., van der Burg, S. H., Wada, T., Beissert, S., Melief, C. J. & Penninger, J. M. (2007). Spontaneous tumor rejection by cbl-b-deficient CD8+ T cells. J Exp Med 204, 879-91.

London, E. (1992). "Diphtheria toxin: membrane interaction and membrane translocation." Biochim Biophys Acta 1113(1): 25-51.

Lord-Dufour et al., (2009) "Evidence for transcriptional regulation of the glucose-6-phosphate transporter by HIF-1alpha: Targeting G6PT with mumbaistatin analogs in hypoxic mesenchymal stromal cells". Stem cells 27: 489-497.

Lorieau, J. L., J. M. Louis and A. Bax (2010). "The complete influenza hemagglutinin fusion domain adopts a tight helical hairpin arrangement at the lipid:water interface." Proc Natl Acad Sci USA 107(25): 11341-11346.

Lin, A., Yan, W. H., Xu, H. H., Gan, M. F., Cai, J. F., Zhu, M. & Zhou, M. Y. (2007). HLA-G expression in human ovarian carcinoma counteracts NK cell function. Ann Oncol 18, 1804-9.

Liu, Q., Zhou, H., Langdon, W. Y. & Zhang, J. (2014). E3 ubiquitin ligase Cbl-b in innate and adaptive immunity. Cell Cycle 13, 1875-84.

Lu, S. J., Q. Feng, Y. Ivanova, C. Luo, T. Li, F. Li, G. R. Honig and R. Lanza (2007). "Recombinant HoxB4 fusion proteins enhance hematopoietic differentiation of human embryonic stem cells." Stem Cells Dev 16(4): 547-559.

Luan et al., (2015). "Peptide amphiphiles with multifunctional fragments promoting cellular uptake and endosomal escape as efficient gene vectors." J. Mater. Chem. B, 3: 1068-1078.

Lutz-Nicoladoni, C., Wolf, D. & Sopper, S. (2015). Modulation of Immune Cell Functions by the E3 Ligase Cbl-b. Front Oncol 5, 58.

Mack, M., B. Luckow, P. J. Nelson, J. Cihak, G. Simmons, P. R. Clapham, N. Signoret, M. Marsh, M. Stangassinger, F. Borlat, T. N. Wells, D. Schlondorff and A. E. Proudfoot (1998). "Aminooxypentane-RANTES induces CCR5 internalization but inhibits recycling: a novel inhibitory mechanism of HIV infectivity." J Exp Med 187(8): 1215-1224.

Maeng, C. H., J. H. Yi, J. Lee, J. Y. Hong, M. K. Choi, H. A. Jung, J. O. Park, S. H. Park, Y. S. Park, W. K. Kang and H. Y. Lim (2013). "Effects of single nucleotide polymorphisms on treatment outcomes and toxicity in patients treated with sunitinib." Anticancer Res 33(10): 4619-4626.

Mahlum, E., D. Mandal, C. Halder, A. Maran, M. J. Yaszemski, R. B. Jenkins, M. E. Bolander and G. Sarkar (2007). "Engineering a noncarrier to a highly efficient carrier peptide for noncovalently delivering biologically active proteins into human cells." Anal Biochem 365(2): 215-221.

Makarova et al., (2011) "Evolution and classification of the CRISPR-Cas systems". Nat Rev Microbiol. 9(6):467-77.

Makkerh, J. P., C. Dingwall and R. A. Laskey (1996). "Comparative mutagenesis of nuclear localization signals reveals the importance of neutral and acidic amino acids." Curr Biol 6(8): 1025-1027.

Martinez-Fong, D., I. Navarro-Quiroga, I. Ochoa, I. Alvarez-Maya, M. A. Meraz, J. Luna and J. A. Arias-Montano (1999). "Neurotensin-SPDP-poly-L-lysine conjugate: a nonviral vector for targeted gene delivery to neural cells." Brain Res Mol Brain Res 69(2): 249-262.

Matalon, O., Fried, S., Ben-Shmuel, A., Pauker, M. H., Joseph, N., Keizer, D., Piterburg, M. & Barda-Saad, M. (2016). Dephosphorylation of the adaptor LAT and phospholipase C-gamma by SHP-1 inhibits natural killer cell cytotoxicity. Sci Signal 9, ra54.

Maurer, M. and E. von Stebut (2004). "Macrophage inflammatory protein-1." Int J Biochem Cell Biol 36(10): 1882-1886.

McKay, T., P. Reynolds, S. Jezzard, D. Curiel and C. Coutelle (2002). "Secretin-mediated gene delivery, a specific targeting mechanism with potential for treatment of biliary and pancreatic disease in cystic fibrosis." Mol Ther 5(4): 447-454.

Midoux, P., A. Kichler, V. Boutin, J. C. Maurizot and M. Monsigny (1998). "Membrane permeabilization and efficient gene transfer by a peptide containing several histidines." Bioconjug Chem 9(2): 260-267.

Milenkovic, D., T. Ramming, J. M. Muller, L. S. Wenz, N. Gebert, A. Schulze-Specking, D. Stojanovski, S. Rospert and A. Chacinska (2009). "Identification of the signal directing Tim9 and Tim10 into the intermembrane space of mitochondria." Mol Biol Cell 20(10): 2530-2539.

Miyoshi, I., N. Kasai and Y. Hayashizaki (1994). "[Structure and regulation of human thyroid-stimulating hormone (TSH) gene]." Nihon Rinsho 52(4): 940-947.

Moede, T., B. Leibiger, H. G. Pour, P. Berggren and I. B. Leibiger (1999). "Identification of a nuclear localization signal, RRMKWKK, in the homeodomain transcription factor PDX-1." FEBS Lett 461(3): 229-234.

Montrose, K., Y. Yang, X. Sun, S. Wiles and G. W. Krissansen (2013). "Xentry, a new class of cell-penetrating peptide uniquely equipped for delivery of drugs." Sci Rep 3: 1661.

Moreland, R. B., G. L. Langevin, R. H. Singer, R. L. Garcea and L. M. Hereford (1987). "Amino acid sequences that determine the nuclear localization of yeast histone 2B." Mol Cell Biol 7(11): 4048-4057.

Morris, M. C., L. Chaloin, M. Choob, J. Archdeacon, F. Heitz and G. Divita (2004). "Combination of a new generation of PNAs with a peptide-based carrier enables efficient targeting of cell cycle progression." Gene Ther 11(9): 757-764.

Morris, M. C., J. Depollier, J. Mery, F. Heitz and G. Divita (2001). "A peptide carrier for the delivery of biologically active proteins into mammalian cells." Nat Biotechnol 19(12): 1173-1176.

Nakanishi, A., D. Shum, H. Morioka, E. Otsuka and H. Kasamatsu (2002). "Interaction of the Vp3 nuclear localization signal with the importin alpha 2/beta heterodimer directs nuclear entry of infecting simian virus 40." J Virol 76(18): 9368-9377.

O'Keefe, D. O. (1992). "Characterization of a full-length, active-site mutant of diphtheria toxin." Arch Biochem Biophys 296(2): 678-684.

Paolino, M., Choidas, A., Wallner, S., Pranjic, B., Uribesalgo, I., Loeser, S., Jamieson, A. M., Langdon, W. Y., Ikeda, F., Fededa, J. P., Cronin, S. J., Nitsch, R., Schultz-Fademrecht, C., Eickhoff, J., Menninger, S., Unger, A., Torka, R., Gruber, T., Hinterleitner, R., Baier, G., Wolf, D., Ullrich, A., Klebl, B. M. & Penninger, J. M. (2014). The E3 ligase Cbl-b and TAM receptors regulate cancer metastasis via natural killer cells. Nature 507, 508-12.

Parente, R. A., S. Nir and F. C. Szoka, Jr. (1990). "Mechanism of leakage of phospholipid vesicle contents induced by the peptide GALA." Biochemistry 29(37): 8720-8728.

Parameswaran, R., Ramakrishnan, P., Moreton, S. A., Xia, Z., Hou, Y., Lee, D. A., Gupta, K., deLima, M., Beck, R. C. & Wald, D. N. (2016). Repression of GSK3 restores NK cell cytotoxicity in AML patients. Nat Commun 7, 11154.

Patel, P. & Woodgett, J. R. (2017). Glycogen Synthase Kinase 3: A Kinase for All Pathways? Curr Top Dev Biol 123, 277-302.

Paul, R. W., K. E. Weisser, A. Loomis, D. L. Sloane, D. LaFoe, E. M. Atkinson and R. W. Overell (1997). "Gene transfer using a novel fusion protein, GAL4/invasin." Hum Gene Ther 8(10): 1253-1262.

Perez, F., A. Joliot, E. Bloch-Gallego, A. Zahraoui, A. Triller and A. Prochiantz (1992). "Antennapedia homeobox as a signal for the cellular internalization and nuclear addressing of a small exogenous peptide." J Cell Sci 102 (Pt 4): 717-722.

Pimenta, D. C., V. C. Chen, J. Chao, M. A. Juliano and L. Juliano (2000). "Alpha1-antichymotrypsin and kallistatin hydrolysis by human cathepsin D." J Protein Chem 19(5): 411-418.

Poli, A., Michel, T., Theresine, M., Andres, E., Hentges, F. & Zimmer, J. (2009). CD56bright natural killer (NK) cells: an important NK cell subset. Immunology 126, 458-65.

Prieve, M. G. and M. L. Waterman (1999). "Nuclear localization and formation of beta-catenin-lymphoid enhancer factor 1 complexes are not sufficient for activation of gene expression." Mol Cell Biol 19(6): 4503-4515.

Rajagopalan, R., J. Xavier, N. Rangaraj, N. M. Rao and V. Gopal (2007). "Recombinant fusion proteins TAT-Mu, Mu and Mu-Mu mediate efficient non-viral gene delivery." J Gene Med 9(4): 275-286.

Riddell et al., (2014) "Reprogramming committed murine blood cells to induced hematopoietic stem cells with defined factors". Cell, 157: 549-564

Salomone, F., F. Cardarelli, M. Di Luca, C. Boccardi, R. Nifosi, G. Bardi, L. Di Bari, M. Serresi and F. Beltram (2012). "A novel chimeric cell-penetrating peptide with membrane-disruptive properties for efficient endosomal escape." J Control Release 163(3): 293-303.

Salomone F., Cardarelli F, Signore G, Boccardi C, Beltram F. (2013) "In vitro efficient transfection by $CM_{18}$-$Tat_{11}$ hybrid peptide: a new tool for gene-delivery applications." PLoS One. 8(7):e70108.

Schneider, H., R. P. Harbottle, Y. Yokosaki, J. Kunde, D. Sheppard and C. Coutelle (1998). "A novel peptide, PLAEIDGIELTY, for the targeting of alpha9beta1-integrins." FEBS Lett 429(3): 269-273.

Schreiber, V., M. Molinete, H. Boeuf, G. de Murcia and J. Menissier-de Murcia (1992). "The human poly(ADP-ribose) polymerase nuclear localization signal is a bipartite element functionally separate from DNA binding and catalytic activity." EMBO J 11(9): 3263-3269.

Schuster, M. J., G. Y. Wu, C. M. Walton and C. H. Wu (1999). "Multicomponent DNA carrier with a vesicular stomatitis virus G-peptide greatly enhances liver-targeted gene expression in mice." Bioconjug Chem 10(6): 1075-1083.

Scott, M. S., F. M. Boisvert, M. D. McDowall, A. I. Lamond and G. J. Barton (2010). "Characterization and prediction of protein nucleolar localization sequences." Nucleic Acids Res 38(21): 7388-7399.

Shaw, P. A., I. R. Catchpole, C. A. Goddard and W. H. Colledge (2008). "Comparison of protein transduction domains in mediating cell delivery of a secreted CRE protein." Biochemistry 47(4): 1157-1166.

Shawe-Taylor J, Cristianini N (2004) Kernel methods for pattern analysis. Cambridge university press.

Shen et al., (2014) "Improved PEP-FOLD approach for peptide and miniprotein structure prediction". J. Chem. Theor. Comput. 10:4745-4758.

Shoya, Y., T. Kobayashi, T. Koda, K. Ikuta, M. Kakinuma and M. Kishi (1998). "Two proline-rich nuclear localization signals in the amino- and carboxyl-terminal regions of the Borna disease virus phosphoprotein." J Virol 72(12): 9755-9762.

Somasekaram, A., A. Jarmuz, A. How, J. Scott and N. Navaratnam (1999). "Intracellular localization of human cytidine deaminase. Identification of a functional nuclear localization signal." J Biol Chem 274(40): 28405-28412.

Stojanovski, D., M. Bohnert, N. Pfanner and M. van der Laan (2012). "Mechanisms of protein sorting in mitochondria." Cold Spring Harb Perspect Biol 4(10).

Sudbeck, P. and G. Scherer (1997). "Two independent nuclear localization signals are present in the DNA-binding high-mobility group domains of SRY and SOX9." J Biol Chem 272(44): 27848-27852.

Sung, M. S., J. Y. Mun, O. Kwon, K. S. Kwon and D. B. Oh (2013). "Efficient myogenic differentiation of human adipose-derived stem cells by the transduction of engineered MyoD protein." Biochem Biophys Res Commun 437(1): 156-161.

Takahashi, K. and S. Yamanaka (2006). "Induction of pluripotent stem cells from mouse embryonic and adult fibroblast cultures by defined factors." Cell 126(4): 663-676.

Takeda, A., C. Goolsby and N. R. Yaseen (2006). "NUP98-HOXA9 induces long-term proliferation and blocks differentiation of primary human CD34+hematopoietic cells." Cancer Res 66(13): 6628-6637.

Tan, Y., Z. Xie, M. Ding, Z. Wang, Q. Yu, L. Meng, H. Zhu, X. Huang, L. Yu, X. Meng and Y. Chen (2010). "Increased levels of FoxA1 transcription factor in pluripotent P19 embryonal carcinoma cells stimulate neural differentiation." Stem Cells Dev 19(9): 1365-1374.

Tan, Y. X., C. Chen, Y. L. Wang, S. Lin, Y. Wang, S. B. Li, X. P. Jin, H. W. Gao, F. S. Du, F. Gong and S. P. Ji (2012). "Truncated peptides from melittin and its analog with high lytic activity at endosomal pH enhance branched polyethylenimine-mediated gene transfection." J Gene Med 14(4): 241-250.

Thévenet et al., "PEP-FOLD: an updated de novo structure prediction server for both linear and disulfide bonded cyclic peptides." Nucleic Acids Res. 2012. 40, W288-293.

Uherek, C., J. Fominaya and W. Wels (1998). "A modular DNA carrier protein based on the structure of diphtheria toxin mediates target cell-specific gene delivery." J Biol Chem 273(15): 8835-8841.

Varkouhi, A. K., M. Scholte, G. Storm and H. J. Haisma (2011). "Endosomal escape pathways for delivery of biologicals." J Control Release 151(3): 220-228.

Veach, R. A., D. Liu, S. Yao, Y. Chen, X. Y. Liu, S. Downs and J. Hawiger (2004). "Receptor/transporter-independent targeting of functional peptides across the plasma membrane." J Biol Chem 279(12): 11425-11431.

Vives, E., P. Brodin and B. Lebleu (1997). "A truncated HIV-1 Tat protein basic domain rapidly translocates through the plasma membrane and accumulates in the cell nucleus." J Biol Chem 272(25): 16010-16017.

Wagstaff, K. M., D. J. Glover, D. J. Tremethick and D. A. Jans (2007). "Histone-mediated transduction as an efficient means for gene delivery." Mol Ther 15(4): 721-731.

Warr, M. R., M. Binnewies, J. Flach, D. Reynaud, T. Garg, R. Malhotra, J. Debnath and E. Passegue (2013). "FOXO3A directs a protective autophagy program in haematopoietic stem cells." Nature 494(7437): 323-327.

Welch, K., J. Franke, M. Kohler and I. G. Macara (1999). "RanBP3 contains an unusual nuclear localization signal that is imported preferentially by importin-alpha3." Mol Cell Biol 19(12): 8400-8411.

Wiedenheft et al., (2011). RNA-guided complex from a bacterial immune system enhances target recognition through seed sequence interactions. Proc. Natl. Acad. Sci. USA 108, 10092-10097.

Witzel, I., M. Graeser, T. Karn, M. Schmidt, R. Wirtz, D. Schutze, A. Rausch, F. Janicke, K. Milde-Langosch and V. Muller (2013). "Androgen receptor expression is a predictive marker in chemotherapy-treated patients with endocrine receptor-positive primary breast cancers." J Cancer Res Clin Oncol 139(5): 809-816.

Wu, J., L. Zhou, K. Tonissen, R. Tee and K. Artzt (1999). "The quaking I-5 protein (QKI-5) has a novel nuclear localization signal and shuttles between the nucleus and the cytoplasm." J Biol Chem 274(41): 29202-29210.

Wu, D., Kuiaste, I., Moreau, P., Carosella, E. & Yotnda, P. (2015). Rescuing lymphocytes from HLA-G immunosuppressive effects mediated by the tumor microenvironment. Oncotarget 6, 37385-97.

Wyman, T. B., F. Nicol, O. Zelphati, P. V. Scaria, C. Plank and F. C. Szoka, Jr. (1997). "Design, synthesis, and characterization of a cationic peptide that binds to nucleic acids and permeabilizes bilayers." Biochemistry 36(10): 3008-3017.

Ye, S. R., Yang, H., Li, K., Dong, D. D., Lin, X. M. & Yie, S. M. (2007a). Human leukocyte antigen G expression: as a significant prognostic indicator for patients with colorectal cancer. Mod Pathol 20, 375-83.

Yie, S. M., Yang, H., Ye, S. R., Li, K., Dong, D. D. & Lin, X. M. (2007b). Expression of human leukocyte antigen G (HLA-G) correlates with poor prognosis in gastric carcinoma. Ann Surg Oncol 14, 2721-9.

Yie, S. M., Yang, H., Ye, S. R., Li, K., Dong, D. D. & Lin, X. M. (2007c). Expression of human leucocyte antigen G (HLA-G) is associated with prognosis in non-small cell lung cancer. Lung Cancer 58, 267-74.

Yie, S. M., Yang, H., Ye, S. R., Li, K., Dong, D. D. & Lin, X. M. (2007d). Expression of HLA-G is associated with prognosis in esophageal squamous cell carcinoma. Am J Clin Pathol 128, 1002-9.

Yu, Z., C. H. Lee, C. Chinpaisal and L. N. Wei (1998). "A constitutive nuclear localization signal from the second zinc-finger of orphan nuclear receptor TR2." J Endocrinol 159(1): 53-60.

Zetsche et al., (2015). "Cpf1 Is a Single RNA-Guided Endonuclease of a Class 2 CRISPR-Cas System". Cell. 25. pii: S0092-8674(15)01200-3 [http://dx.doi.org/10.1016/j.cell.2015.09.038].

Zhen, Z. J., Ling, J. Y., Cai, Y., Luo, W. B. & He, Y. J. (2013). Impact of HLA-E gene polymorphism on HLA-E expression in tumor cells and prognosis in patients with stage III colorectal cancer. Med Oncol 30, 482.

Zhou, H., S. Wu, J. Y. Joo, S. Zhu, D. W. Han, T. Lin, S. Trauger, G. Bien, S. Yao, Y. Zhu, G. Siuzdak, H. R. Scholer, L. Duan and S. Ding (2009). "Generation of induced pluripotent stem cells using recombinant proteins." Cell Stem Cell 4(5): 381-384.

SEQUENCE LISTING (10242 sequences)

SEQ ID NO: 1 - protein, 18 aa, Artificial sequence
  CM18
KWKLFKKIGAVLKVLTTG

SEQ ID NO: 2 - protein, 189 aa, Artificial sequence
  Diphtheria toxin T domain (DT)
VGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPG

SEQ ID NO: 3 - protein, 30 aa, Artificial sequence
  GALA
WEAALAEALAEALAEHLAEALAEALEALAA

SEQ ID NO: 4 - protein, 115 aa, Artificial sequence
  PEA
VLAGNPAKHDLDIKPTVISHRLHFPEGGSLAALTAHQACHLPLETFTRHRQPRGWEQLEQCGYPVQRLVALYLAARLSWNQVDQVIRNALASPGSGGDLGEAIREQPEQARLALT

SEQ ID NO: 5 - protein, 24 aa, Artificial sequence
  INF-7
GLFEAIEGFIENGWEGMIDGWYGC

SEQ ID NO: 6 - protein, 26 aa, Artificial sequence
  LAH4
KKALLALALHHLAHLALHLALALKKA

SEQ ID NO: 7 - protein, 24 aa, Artificial sequence
  HGP
LLGRRGWEVLKYWWNLLQYWSQEL

SEQ ID NO: 8 - protein, 23 aa, Artificial sequence
  H5WYG
GLFHAIAHFIHGGWHGLIHGWYG

SEQ ID NO: 9 - protein, 23 aa, Artificial sequence
  HA2
GLFGAIAGFIENGWEGMIDGWYG

SEQ ID NO: 10 - protein, 23 aa, Artificial sequence
  EB1
LIRLWSHLIHIWFQNRRLKWKKK

SEQ ID NO: 11 - protein, 25 aa, Artificial sequence
  VSVG
KFTIVFPHNQKGNWKNVPSNYHYCP

SEQ ID NO: 12 - protein, 115 aa, Artificial sequence
  Pseudomonas toxin
EGGSLAALTAHQACHLPLETFTRHRQPRGWEQLEQCGYPVQRLVALYLAARLSWNQVDQVIRNALASPGSGGDLGEAIREQPEQARLALTLAAAESERFVRQGTGNDEAGAANAD

SEQ ID NO: 13 - protein, 26 aa, Artificial sequence
  Melittin
GIGAVLKVLTTGLPALISWIKRKRQQ

SEQ ID NO: 14 - protein, 30 aa, Artificial sequence
  KALA
WEAKLAKALAKALAKHLAKALAKALKACEA

SEQ ID NO: 15 - protein, 20 aa, Artificial sequence
  JST-1
GLFEALLELLESLWELLLEA

SEQ ID NO: 16 - protein, 16 aa, Artificial sequence
  SP
AAVALLPAVLLALLAP

SEQ ID NO: 17 - protein, 11 aa, Artificial sequence
  TAT
YGRKKRRQRRR

SEQ ID NO: 18 - protein, 16 aa, Artificial sequence
  Penetratin (Antennapedia)
RQIKIWFQNRRMKWKK

SEQ ID NO: 19 - protein, 18 aa, Artificial sequence
  pVEC
LLIILRRRIRKQAHAHSK

SEQ ID NO: 20 - protein, 22 aa, Artificial sequence
  M918
MVTVLFRRLRIRRACGPPRVRV

SEQ ID NO: 21 - protein, 21 aa, Artificial sequence
  Pep-1
KETWWETWWTEWSQPKKKRKV

SEQ ID NO: 22 - protein, 21 aa, Artificial sequence
  Pep-2
KETWFETWFTEWSQPKKKRKV

SEQ ID NO: 23 - protein, 7 aa, Artificial sequence
  Xentry
LCLRPVG

SEQ ID NO: 24 - protein, 9 aa, Artificial sequence
  Arginine stretch
RRRRRRRRR

SEQ ID NO: 25 - protein, 26 aa, Artificial sequence
  Transportan
WTLNSAGYLLGKINLKALAALAKKIL

SEQ ID NO: 26 - protein, 18 aa, Artificial sequence
  SynB1
RGGRLSYSRRRFSTSTGR

SEQ ID NO: 27 - protein, 10 aa, Artificial sequence
  SynB3
RRLSYSRRRF

SEQ ID NO: 28 - protein, 5 aa, Artificial sequence
  E1a
KRPRP

SEQ ID NO: 29 - protein, 7 aa, Artificial sequence
  SV40 T-Ag
PKKKRKV

SEQ ID NO: 30 - protein, 9 aa, Artificial sequence
  c-myc
PAAKRVKLD

SEQ ID NO: 31 - protein, 22 aa, Artificial sequence
  Op-T-NLS
SSDDEATADSQHAAPPKKKRKV

SEQ ID NO: 32 - protein, 5 aa, Artificial sequence
  Vp3
KKKRK

SEQ ID NO: 33 - protein, 16 aa, Artificial sequence
  Nucleoplasmin
KRPAATKKAGQAKKKK

SEQ ID NO: 34 - protein, 10 aa, Artificial sequence
  Histone 2B NLS
DGKKRKRSRK

SEQ ID NO: 35 - protein, 24 aa, Artificial sequence
  Xenopus N1
VRKKRKTEEESPLKDKDAKKSKQE

SEQ ID NO: 36 - protein, 19 aa, Artificial sequence
  PARP
KRKGDEVDGVDECAKKSKK

SEQ ID NO: 37 - protein, 7 aa, Artificial sequence
  PDX-1
RRMKWKK

SEQ ID NO: 38 - protein, 7 aa, Artificial sequence
  QKI-5
RVHPYQR

SEQ ID NO: 39 - protein, 24 aa, Artificial sequence
  HCDA
KRPACTLKPECVQQLLVCSQEAKK

SEQ ID NO: 40 - protein, 7 aa, Artificial sequence
  H2B
GKKRSKA

SEQ ID NO: 41 - protein, 6 aa, Artificial sequence
  v-Rel
KAKRQR

SEQ ID NO: 42 - protein, 5 aa, Artificial sequence
  Amida
RKRRR

SEQ ID NO: 43 - protein, 9 aa, Artificial sequence
  RanBP3
PPVKRERTS

SEQ ID NO: 44 - protein, 10 aa, Artificial sequence
  Pho4p
PYLNKRKGKP

SEQ ID NO: 45 - protein, 9 aa, Artificial sequence
  LEF-1
KKKKRKREK

SEQ ID NO: 46 - protein, 9 aa, Artificial sequence
  TCF-1
KKKRRSREK

SEQ ID NO: 47 - protein, 8 aa, Artificial sequence
  BDV-P
PRPRKIPR

SEQ ID NO: 48 - protein, 20 aa, Artificial sequence
  TR2
KDCVINKHHRNRCQYCRLQR

SEQ ID NO: 49 - protein, 5 aa, Artificial sequence
  SOX9
PRRRK

SEQ ID NO: 50 - protein, 8 aa, Artificial sequence
  Max
PQSRKKLR

SEQ ID NO: 51 - protein, 9 aa, Artificial sequence
  Mitochondrial signal sequence from Tim9
NLVERCFTD

SEQ ID NO: 52 - protein, 12 aa, Artificial sequence
  Mitochondrial signal sequence from Yeast cytochrome c oxidase subunit IV
MLSLRQSIRFFK

SEQ ID NO: 53 - protein, 16 aa, Artificial sequence
  Mitochondrial signal sequence from 18S rRNA
MLISRCKWSRFPGNQR

SEQ ID NO: 54 - protein, 3 aa, Artificial sequence
  Peroxisome signal sequence - PTS1
SKL

SEQ ID NO: 55 - protein, 17 aa, Artificial sequence
  Nucleolar signal sequence from BIRC5
MQRKPTIRRKNLRLRRK

SEQ ID NO: 56 - protein, 11 aa, Artificial sequence
  Nucleolar signal sequence from RECQL4
KQAWKQKWRKK

SEQ ID NO: 57 - protein, 29 aa, Artificial sequence
  CM18-TAT
KWKLFKKIGAVLKVLTTGYGRKKRRQRRR

SEQ ID NO: 58 - protein, 34 aa, Artificial sequence
  CM18-Penetratin
KWKLFKKIGAVLKVLTTGRQIKIWFQNRRMKWKK

SEQ ID NO: 59 - protein, 36 aa, Artificial sequence
  His-CM18-TAT
MHHHHHHKWKLFKKIGAVLKVLTTGYGRKKRRQRRR

SEQ ID NO: 60 - protein, 290 aa, Artificial sequence
  GFP
MHHHHHHGGGGSGGGGSGGASTGTGIRMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKGGSGGGSGGGSGWIRASSGGREIS

SEQ ID NO: 61 - protein, 317 aa, Artificial sequence
  TAT-GFP
MHHHHHHGGGGSGGGGSGGASTGTGRKKRRQRRRPPQGGGGSGGGGSGGGTGIRMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKGGSGGGSGGGSGWIRASSGGREIS

SEQ ID NO: 62 - protein, 327 aa, Artificial sequence
  GFP-NLS
MHHHHHHGGGGSGGGGSGGASTGIRMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKGGSGGGSGGGSGWIRASSGGRSSDDEATADSQHAAPPKKKRKVGGSGGGSGGGSGGGRGTEIS

SEQ ID NO: 63 - protein, 14 aa, Artificial Sequence
  C(LLKK)3C
CLLKKLLKKLLKKC

SEQ ID NO: 64 - protein, 14 aa, Artificial Sequence
  G(LLKK)3G
GLLKKLLKKLLKKG

SEQ ID NO: 65 - protein, 11 aa, Artificial Sequence
  PTD4
YARAAARQARA

SEQ ID NO: 66 - protein, 30 aa, Artificial Sequence
  TAT-CM18
YGRKKRRQRRRCKWKLFKKIGAVLKVLTTG

SEQ ID NO: 67 - protein, 42 aa, Artificial Sequence
  TAT-KALA
YGRKKRRQRRRCWEAKLAKALAKALAKHLAKALAKALKACEA

SEQ ID NO: 68 - protein, 35 aa, Artificial Sequence
  His-CM18-PTD4
HHHHHHKWKLFKKIGAVLKVLTTGYARAAARQARA

SEQ ID NO: 69 - protein, 33 aa, Artificial Sequence
  His-CM18-9Arg
HHHHHHKWKLFKKIGAVLKVLTTGRRRRRRRRR

SEQ ID NO: 70 - protein, 50 aa, Artificial Sequence
  His-CM18-Transportan
HHHHHHKWKLFKKIGAVLKVLTTGGWTLNSAGYLLKINLKALAALAKKIL

SEQ ID NO: 71 - protein, 43 aa, Artificial Sequence
  His-LAH4-PDT4
HHHHHHKKALLALALHHLAHLALHLALALKKAYARAAARQARA

SEQ ID NO: 72 - protein, 31 aa, Artificial Sequence
  His-C(LLKK)3C-PDT4
HHHHHHCLLKKLLKKLLKKCYARAAARQARA

SEQ ID NO: 73 - protein, 324 aa, Artificial Sequence
  mCherry-NLS
MHHHHHHGGGGSGGGGSGGASTGIRMVSKCEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGQVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYKGGSGGGSGGGSGWIRASSGGRSSDDEATADSQHAAPPKKKRKVGGSGGGSGGGSGGGRGTEIS

SEQ ID NO: 74 - protein, 1414 aa, Artificial Sequence
  Cas9-NLS
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGRSSDDEATADSQHAAPPKKKRKVGGSGGGSGGGSGGGRHHHHHH

SEQ ID NO: 75 - RNA, 42 nt, Artificial Sequence
  crRNA (Example 13.3)
gaguccgagcagaagaagaaguuuuagagcuaugcuguuuug

SEQ ID NO: 76 - RNA, 69 nt, Artificial Sequence
  tracrRNA (Example 13.3)
aaacagcauagcaaguuaaaauaaggcuaguccguuaucaacuugaaaaaguggcaccgagucggugcu

SEQ ID NO: 77 - RNA, 69 nt, Artificial Sequence; identical to SEQ ID NO: 76
  tracrRNA (Example 13.5)

SEQ ID NO: 78 - RNA, 42 nt, Artificial Sequence
  PPIB crRNA (Example 13.5)
guguauuuugaccuacgaauguuuuagagcuaugcuguuuug

SEQ ID NO: 79 - RNA, 74 nt, Artificial Sequence
  PPIB tracrRNA (Example 13.5)
aacagcauagcaaguuaaaauaaggcuaguccguuaucaacuugaaaaaguggcaccgagucggugcuuuuuuu

SEQ ID NO: 80 - protein, 246 aa, Artificial Sequence
  HOXB4-WT
MHHHHHHMAMSSFLINSNYVDPKFPPCEEYSQSDYLPSDHSPGYYAGGQRRESSFQPEAGFGRRAACTVQRYPPPPPPPPPPGLSPRAPAPPPAGALLPEPGQRCEAVSSSPPPPPCAQNPLHPSPSHSACKEPVVYPWMRKVHVSTVNPNYAGGEPKRSRTAYTRQQVLELEKEFHYNRYLTRRRRVEIAHALCLSERQIKIWFQNRRMKWKKDHKLPNTKIRSGGAAGSAGGPPGRPNGGPRAL

SEQ ID NO: 81 - protein, 17 aa, Artificial Sequence
  His-PTD4
HHHHHHYARAAARQARA

SEQ ID NO: 82 - protein, 41 aa, Artificial Sequence
  PTD4-KALA
YARAAARQARAWEAKLAKALAKALAKHLAKALAKALKACEA

SEQ ID NO: 83 - protein, 39 aa, Artificial Sequence
  9Arg-KALA
RRRRRRRRRWEAKLAKALAKALAKHLAKALAKALKACEA

SEQ ID NO: 84 - protein, 51 aa, Artificial Sequence
  Pep1-KALA
KETWWETWWTEWSQPKKKRKVWEAKLAKALAKALAKHLAKALAKALKACEA

SEQ ID NO: 85 - protein, 37 aa, Artificial Sequence
  Xentry-KALA
LCLRPVGWEAKLAKALAKALAKHLAKALAKALKACEA

SEQ ID NO: 86 - protein, 40 aa, Artificial Sequence
  SynB3-KALA
RRLSYSRRRFWEAKLAKALAKALAKHLAKALAKALKACEA

SEQ ID NO: 87 - protein, 36 aa, Artificial Sequence
  VSVG-PTD4
KFTIVFPHNQKGNWKNVPSNYHYCPYARAAARQARA

SEQ ID NO: 88 - protein, 34 aa, Artificial Sequence
  EB1-PTD4
LIRLWSHLIHIWFQNRRLKWKKKYARAAARQARA

SEQ ID NO: 89 - protein, 31 aa, Artificial Sequence
  JST-PTD4
GLFEALLELLESLWELLLEAYARAAARQARA

SEQ ID NO: 90 - protein, 29 aa, Artificial Sequence
  CM18-PTD4
KWKLFKKIGAVLKVLTTGYARAAARQARA

SEQ ID NO: 91 - protein, 35 aa, Artificial Sequence
  6Cys-CM18-PTD4
CCCCCCKWKLFKKIGAVLKVLTTGYARAAARQARA

SEQ ID NO: 92 - protein, 32 aa, Artificial Sequence
  CM18-L1-PTD4
KWKLFKKIGAVLKVLTTGGGSYARAAARQARA

SEQ ID NO: 93 - protein, 36 aa, Artificial Sequence
  CM18-L2-PTD4
KWKLFKKIGAVLKVLTTGGGSGGGSYARAAARQARA

SEQ ID NO: 94 - protein, 41 aa, Artificial Sequence
  CM18-L3-PTD4
KWKLFKKIGAVLKVLTTGGGSGGGSGGGSGYARAAARQARA

SEQ ID NO: 95 - protein, 35 aa, Artificial Sequence
  His-CM18-TAT
HHHHHHKWKLFKKIGAVLKVLTTGYGRKKRRQRRR

SEQ ID NO: 96 - protein, 41 aa, Artificial Sequence
  His-CM18-PTD4-6Cys
HHHHHHKWKLFKKIGAVLKVLTTGYARAAARQARACCCCCC

SEQ ID NO: 97 - protein, 32 aa, Artificial Sequence
  3His-CM18-PTD4
HHHKWKLFKKIGAVLKVLTTGYARAAARQARA

SEQ ID NO: 98 - protein, 41 aa, Artificial Sequence
  12His-CM18-PTD4
HHHHHHHHHHHHKWKLFKKIGAVLKVLTTGYARAAARQARA

SEQ ID NO: 99 - protein, 36 aa, Artificial Sequence
  HA-CM18-PTD4
HHHAHHHKWKLFKKIGAVLKVLTTGYARAAARQARA

SEQ ID NO: 100 - protein, 38 aa, Artificial Sequence
  3HA-CM18-PTD4
HAHHAHHAHKWKLFKKIGAVLKVLTTGYARAAARQARA

SEQ ID NO: 101 - protein, 35 aa, Artificial Sequence
  CM18-His-PTD4
KWKLFKKIGAVLKVLTTGHHHHHHYARAAARQARA

SEQ ID NO: 102 - protein, 41 aa, Artificial Sequence
  His-CM18-PTD4-His
HHHHHHKWKLFKKIGAVLKVLTTGYARAAARQARAHHHHHH

SEQ ID NO: 103 - RNA, 36 nt, Artificial Sequence
  HPRT crRNA
aauuauggggauuacuaggaguuuuagagcuaugcu

SEQ ID NO: 104 - protein, 38 aa, Artificial Sequence
  FSD1
HHHHHHKWKLLRRAAKKAARRYLKLLLKQLKLHHHHHH

SEQ ID NO: 105 - protein, 38 aa, Artificial Sequence
  FSD2
HHHHHHWLKLLRRAAKKAARLYRKLLRKARKLHHHHHH

SEQ ID NO: 106 - protein, 38 aa, Artificial Sequence
  FSD3
HHHHHHKRKKKRRAKKKRAWLYLALLLWALALHHHHHH

SEQ ID NO: 107 - protein, 38 aa, Artificial Sequence
  FSD4
HHHHHHKRQLKRKLRKWKRLLRLLRLLARLWLHHHHHH

SEQ ID NO: 108 - protein, 37 aa, Artificial Sequence
  FSD5
HHHHHHLLKLWSRLLKLWTQGRRLKAKRAKAHHHHHH

SEQ ID NO: 109 - protein, 34 aa, Artificial Sequence
  FSD6
HHHHHHWYLALLALYWQRAKAKTRQRRRHHHHHH

SEQ ID NO: 110 - protein, 33 aa, Artificial Sequence
  FSD7
HHHHHHWARLARAFARAIKKLYARALRRQARTG

SEQ ID NO: 111 - protein, 33 aa, Artificial Sequence
  FSD8
HHHHHHKWKLARAFARAIKKLYARALRRQARTG

SEQ ID NO: 112 - protein, 39 aa, Artificial Sequence
  FSD8
HHHHHHKWKLARAFARAIKKLYARALRRQARTGHHHHHH

SEQ ID NO: 113 - protein, 34 aa, Artificial Sequence
  FSD10
KWKLARAFARAIKKLGGSGGGSYARALRRQARTG

SEQ ID NO: 114 - protein, 36 aa, Artificial Sequence
  FSD11
HHHHHHKWKLARAFARALRAIKKLYARALRRQARTG

SEQ ID NO: 115 - protein, 27 aa, Artificial Sequence
  FSD12
KWKLARAFARAIKKLYARALRRQARTG

SEQ ID NO: 116 - protein, 40 aa, Artificial Sequence
  FSD13
HHHHHHKWAKLLRAFAKAIKKLYARLARRQARTGHHHHHH

SEQ ID NO: 117 - protein, 38 aa, Artificial Sequence
  FSD14
HHHHHHLALARWARYFRILAKLKRTKRGQAKAHHHHHH

SEQ ID NO: 118 - protein, 39 aa, Artificial Sequence
  FSD15
HHHHHHKWKIARAFARSLKKLYARLLARQAKTGHHHHHH

SEQ ID NO: 119 - protein, 31 aa, Artificial Sequence
  FSD16
HHHHHHLLKLWSRLLKLWTQGRRLKAKRAKA

SEQ ID NO: 120 - protein, 37 aa, Artificial Sequence
  FSD17
HHHHHHLAKLFKWLRALIRQGAKRKTKRASAHHHHHH

SEQ ID NO: 121 - protein, 32 aa, Artificial Sequence
  FSD18
LLKLWSRLLKLWTQGGSGGGSGRRLKAKRAKA

SEQ ID NO: 122 - protein, 42 aa, Artificial Sequence
  FSD19
HHHHHHLLKLWSRLLKTWTQGRRLKAKSAQASTRQAHHHHHH

SEQ ID NO: 123 - protein, 33 aa, Artificial Sequence
  FSD20
HHHHAAVLKLWKRLLKLFRKGRRLKAKRAKAKR

SEQ ID NO: 124 - protein, 31 aa, Artificial Sequence
  FSD21
HHHHHHFLKIWSRLIKIWTQGRRKGAQAAFR

SEQ ID NO: 125 - protein, 38 aa, Artificial Sequence
  FSD22
HHHHHHVLKLWSRILKAFTQGRRMAAKRAKCNHHHHHH

SEQ ID NO: 126 - protein, 37 aa, Artificial Sequence
  FSD23
HHHHHHLLKLWSRLLKEWTQGRRLEAKRAEAHHHHHH

SEQ ID NO: 127 - protein, 34 aa, Artificial Sequence
  FSD24
HHHHHHLLCLWSRLLKLWTQGERLKAKCAKACER

SEQ ID NO: 128 - protein, 35 aa, Artificial Sequence
  FSD25
HHHHHHVWKLFWTLLAAIYGRGKARQKRAKRQARG

SEQ ID NO: 129 - protein, 35 aa, Artificial Sequence
  FSD26
ALLGLFIKWVKKVGTLFRKAKAGAQNRRAKAQKGK

SEQ ID NO: 130 - protein, 37 aa, Artificial Sequence
  FSN1
HHHHHHKRKRRSKKRKLWTQGWLLLALLALAHHHHHH

SEQ ID NO: 131 - protein, 37 aa, Artificial Sequence
  FSN2
HHHHHHKLKLRSRLKWGRTQLWRALAKKALLHHHHHH

SEQ ID NO: 132 - protein, 36 aa, Artificial Sequence
  FSN3
HHHHHHQFLCFWLNKMGKHNTVWHGRHLKCHKRGKG

SEQ ID NO: 133 - protein, 35 aa, Artificial Sequence
  FSN4
HHHHHHLLYLWRRLLKFWCAGRRVYAKCAKAYGCF

SEQ ID NO: 134 - protein, 39 aa, Artificial Sequence
  FSN5
HHHHHHLLKLWRRLLKLFRKALRALAKRAKSALKRAQAA

SEQ ID NO: 135 - protein, 39 aa, Artificial Sequence
  FSN6
HHHHHHLLKLWSRLLKLWTQALRALAKRAKALAHHHHHH

SEQ ID NO: 136 - protein, 31 aa, Artificial Sequence
  FSN7
LIKLWSRFIKFWTQGRRIKAKLARAGQSWFG

SEQ ID NO: 137 - protein, 19 aa, Artificial Sequence
  FSN8
HHHHHHFRKLWLAIVRAKK

SEQ ID NO: 138 - protein, 35 aa, Artificial Sequence
  FSD27
HHHHHHKWKLFWEAKLAKYARAAARQARAARQARA

SEQ ID NO: 139 - protein, 35 aa, Artificial Sequence
  FSD28
HHHHHHHMAHLWESNARKFWKKAFAQHAAAHIAEA

SEQ ID NO: 140 - protein, 35 aa, Artificial Sequence
  FSD29
LHHHSHHLIHIWLLFKLKLKKKKAARRARRARRHH

SEQ ID NO: 141 - protein, 35 aa, Artificial Sequence
  FSD30
HHHHHHCLLKKWEAKLAKKIGGGGRQARAKALAKA

SEQ ID NO: 142 - protein, 35 aa, Artificial Sequence
  FSD31
YHHHHHKWKKRWEAKLAKALRAAGRQARAKALAKA

SEQ ID NO: 143 - protein, 35 aa, Artificial Sequence
  FSD32
IVRHEHCMIHLWYKNLAKYCSTSHARRLARRRAHH

SEQ ID NO: 144 - protein, 35 aa, Artificial Sequence
  FSD33
HHHHHHHHRQRRRWEARGGFLGGGGYARAARQARA

SEQ ID NO: 145 - protein, 35 aa, Artificial Sequence
  FSD34
HHHHHHKLIHIWEAKLFKKIRAAARQARARRAAKA

SEQ ID NO: 146 - protein, 35 aa, Artificial Sequence
  FSD35
HHHHHHKLLKRWEAKLAKALAKALAKHLAKALAKA

SEQ ID NO: 147 - protein, 35 aa, Artificial Sequence
  FSD36
HHHHHHCLIHIWEAKLAKKCGGGGYARAAARQARA

SEQ ID NO: 148 - protein, 35 aa, Artificial Sequence
  FSD37
RLHHSHHLIHIWLLFKLKLKKKKRAARRARRHHHL

SEQ ID NO: 149 - protein, 35 aa, Artificial Sequence
  FSD38
GHHHHHHHLIHIWEAKLAKLAKALARAAARQARAK

SEQ ID NO: 150 - protein, 35 aa, Artificial Sequence
  FSD39
HHHHHHHHRQRRRWEARGFLGGGGYARAARQARAA

SEQ ID NO: 151 - protein, 35 aa, Artificial Sequence
  FSD40
YGRKKRYMLRLWYQNLRMYCKKAYAQHRARQHAKL

SEQ ID NO: 152 - protein, 35 aa, Artificial Sequence
  FSD41
LHHHHHKLIHIWEAKLAKALAKALARRAAARQARA

SEQ ID NO: 153 - protein, 35 aa, Artificial Sequence
  FSD42
HHHHHHCMKVVWEIVLAKYKGGGGRARAASRRARA

SEQ ID NO: 154 - DNA, 72 bp, Artificial Sequence
  Short DNA template
tgaaatggagagctaaattatggggattacaagcttgatagcgaaggggcagcaatgagttgacactacaga

SEQ ID NO: 155 - protein, 1353 aa, Artificial Sequence
  Cpf1-NLS
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGGRSSDDEATADSQHAAPPKKKRKVGGSGGGSGGGSGGGRHHHHHH

SEQ ID NO: 156 - DNA, 1631 bp, Artificial Sequence
  GFP coding DNA template
aagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagctcaagcttcgaattctgcagtcgacggtaccgcgggcccgggatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaa

SEQ ID NO: 157 - RNA, 42 nt, Artificial Sequence
  DNMT1 crRNA
aauuucuacuguuguagaucugaugguccaugucuguuacuc

SEQ ID NO: 158 - protein, 14 aa, Artificial Sequence
  FSD5, FSD16, FSD18, FSD19, FSD20, FSD22, and FSD23 consensus
  MISC_FEATURE (5)..(5): N, Q, S, T, K, R, H, D, E, C, Y (polar/hydrophilic residues)
  MISC_FEATURE (7)..(7): G, A, V, L, I, P, Y, F, W, M, C (non-polar / hydrophobic)
  MISC_FEATURE (10)..(10): Any amino acid other than proline
  MISC_FEATURE (11)..(11): N, Q, S, T, K, R, H, D, E, C, Y (polar/hydrophilic residues)
  MISC_FEATURE (12)..(12): N, Q, S, T, K, R, H, D, E, C, Y (polar/hydrophilic residues)
  MISC_FEATURE (13)..(13): N, Q, S, T, K, R, H, D, E, C, Y (polar/hydrophilic residues)
  MISC_FEATURE (13)..(13): N, Q, S, T, K, R, H, D, E, C, Y (polar/hydrophilic residues)
LKLWNRNLKNNNNG

SEQ ID NO: 159 - protein, 8 aa, Artificial Sequence
  FSD5, FSD16, FSD18, FSD19, FSD20, FSD22, FSD23 concensus
  MISC_FEATURE (3)..(3): G, A, V, L, I, P, Y, F, W, M, C (non-polar / hydrophbic)
  MISC_FEATURE (4)..(4): Any amino acid other than proline
  MISC_FEATURE (7)..(7): N, Q, S, T, K, R, H, D, E, C, Y (polar / hydrophilic)
RRNNAKNA

SEQ ID NO: 160 - RNA, 42 nt, Artificial Sequence
  B2M crRNA (Cas9)
gaguagcgcgagcacagcuaguuuuagagcuaugcuguuuug

SEQ ID NO: 161 - RNA, 39 nt, Artificial Sequence
  B2M exon 2 crRNA-1 (Cpf1)
aauuucuacuguuguagauauccauccgacauugaaguu

SEQ ID NO: 162 - RNA, 41 nt, Artificial Sequence
  B2M exon 2 crRNA-2 (Cpf1)
aauuucuacucuuguagauccgauauuccucagguacucca

SEQ ID NO: 163 - RNA, 39 nt, Artificial Sequence
  CBLB crRNA
aauuucuacucuuguagaucuuucuuccuuuaggagaca

SEQ ID NO: 164 - RNA, 39 nt, Artificial Sequence
  GSK3 crRNA
aauuucuacucuuguagauaagaacuaaaauuccagaug

SEQ ID NO: 165 - RNA, 39 nt, Artificial Sequence
  NKG2A crRNA
aauuucuacucuuguagauggggcagauucaggucugag

SEQ ID NO: 166 - RNA, 39 nt, Artificial Sequence
  B2M crRNA-E
aauuucuacucuuguagauauccauccgacauugaaguu

SEQ ID NO: 167 - RNA, 41 nt, Artificial Sequence; identical to SEQ ID NO: 162
  B2M crRNA-J

SEQ ID NO: 168 - RNA, 41 nt, Artificial Sequence
  B2M crRNA-G
aauuucuacucuuguagauuuagagucucgugauguuuaag

SEQ ID NO: 169 - protein, 31 aa, Artificial Sequence
  FSD
HHHHHHFLKFWSRLFKFWTQGRRKGAQAAFR

SEQ ID NO: 170 - protein, 31 aa, Artificial Sequence
  FSD
HHHHHHILKIWSRLIKIWTQGRRKGAQAAIR

SEQ ID NO: 171 - protein, 32 aa, Artificial Sequence
  FSD
HHHHHHFLKIWSRALIKIWTQGLRKGAQAAKR

SEQ ID NO: 172 - protein, 31 aa, Artificial Sequence
  FSD
HHHHHHFLKIWSRLIKIWTQGLRKGAQAAKR

SEQ ID NO: 173 - protein, 31 aa, Artificial Sequence
  FSD
HHHHHHVLKIWSRLIKIWTQGRRKGAQAAVR

SEQ ID NO: 174 - protein, 31 aa, Artificial Sequence
  FSD
HHHHHHFLKVWSRLVKVWTQGRRKGAQAAFR

SEQ ID NO: 175 - protein, 31 aa, Artificial Sequence
  FSD
HHHHHHVLKVWSRLVKVWTQGRRKGAQAAVR

SEQ ID NO: 176 - protein, 31 aa, Artificial Sequence
  FSD
HHHHHHFLKIWQRLIKIWQQGRRKGAQAAFR

SEQ ID NO: 177 - protein, 31 aa, Artificial Sequence
  FSD
HHHHHHFLKIWNRLIKIWNNGRRKGANAAFR

SEQ ID NO: 178 - protein, 30 aa, Artificial Sequence
  FSD
HHHHHHFLKIWSRLIKIWTQGWRTGAQAGF

SEQ ID NO: 179 - protein, 30 aa, Artificial Sequence
  FSD
HHHHHHLLKIWSRLIKGWTQGWRTIAQALG

SEQ ID NO: 180 - protein, 34 aa, Artificial Sequence
  FSD
HHHHHHFLKIWSRLIKIWTQGALWKTLLKKVLKA

SEQ ID NO: 181 - protein, 31 aa, Artificial Sequence
  FSD
HHHHHHFLKIWSRLIKIWPQPRRKGAQAAFR

SEQ ID NO: 182 - protein, 31 aa, Artificial Sequence
  FSD
FLKIWSRLIKIWTQGGSGGGSRRKGAQAAFR

SEQ ID NO: 183 - protein, 30 aa, Artificial Sequence
  FSD
LIRKWIHLIHSWFQNLRRLYARAAARQARA

SEQ ID NO: 184 - protein, 31 aa, Artificial Sequence
  FSD
LLRLWSHLIHLWTQGGSGGGSRRLKAKRAKA

SEQ ID NO: 185 - protein, 31 aa, Artificial Sequence
  FSD
FLKIWSHLIHIWTQGGSGGGSRRLKAKRAKA

SEQ ID NO: 186 - protein, 32 aa, Artificial Sequence
  FSD
LLKLWSRLLKLWTQGGSPPPSGRRLKAKRAKA

SEQ ID NO: 187 - protein, 28 aa, Artificial Sequence
  FSD
HHHHHHMVRVLTRFLRIGARCRRPPVVR

SEQ ID NO: 188 - protein, 30 aa, Artificial Sequence
  FSD
HHHHHHWITWLFKRLKIRRAAGQSKFRIAG

SEQ ID NO: 189 - protein, 30 aa, Artificial Sequence
  FSD
HHHHHHWITWLRKILKRFRKAAQSGFRIAG

SEQ ID NO: 190 - protein, 30 aa, Artificial Sequence
  FSD
HHHHHHWITWLRKILKRFGKAAQSGFRIAR

SEQ ID NO: 191 - protein, 30 aa, Artificial Sequence
  FSD
HHHHHHWITWLRKILKRLGGAAQSIITGGQ

SEQ ID NO: 192 - protein, 30 aa, Artificial Sequence
  FSD
WITWLFKRLKIRRAAGGSGGGSQSKFRIAG

SEQ ID NO: 193 - protein, 36 aa, Artificial Sequence
  FSD
HHHHHHWITWLFKRLKIRRAAGGSGGGSQSKFRIAG

SEQ ID NO: 194 - protein, 32 aa, Artificial Sequence
  FSD
LLKLESRELKLWTQGGSGGGSGRRLKAKRAKA

SEQ ID NO: 195 - protein, 34 aa, Artificial Sequence
  FSD
KWKLARAEARAEKKLGGSGGGSYARALRRQARTG

SEQ ID NO: 196 - protein, 32 aa, Artificial Sequence
  FSD
LLKLWSRLLKLWTQGGSGEGSGRRLKAKRAKA

SEQ ID NO: 197 - protein, 32 aa, Artificial Sequence
  FSD
LLKLWSRLEKLWTQGGSGGGSGRRLKAKRAKA

SEQ ID NO: 198 - protein, 42 aa, Artificial Sequence
  FSD
HHHHHHLLKEWSRLLKTWTQGRRLKAKSAQASTRQAHHHHHH

SEQ ID NO: 199 - protein, 43 aa, Artificial Sequence
  FSD
HHHHHHKKALLALALHHLAHLALHLELALKKAYARAAARQARA

SEQ ID NO: 200 - protein, 23 aa, Artificial Sequence
  FSD
WIRLFTKLWRIFQQGKRIKAKRA

SEQ ID NO: 201 - protein, 29 aa, Artificial Sequence
  FSD
WIRLFTKLWRIFQQGGSGGGSKRIKAKRA

SEQ ID NO: 202 - protein, 23 aa, Artificial Sequence
  FSD
WIRLFTKLWRIFRQGKRIKAKAA

SEQ ID NO: 203 - protein, 29 aa, Artificial Sequence
  FSD
WIRLFTKLWRIFRQGGSGGGSKRIKAKAA

SEQ ID NO: 204 - protein, 25 aa, Artificial Sequence
  FSD
ILKLWSRLIKIWTQGRRLGAQAALR

SEQ ID NO: 205 - protein, 31 aa, Artificial Sequence
  FSD
ILKLWSRLIKIWTQGGSGGGSRRLGAQAALR

SEQ ID NO: 206 - protein, 25 aa, Artificial Sequence
  FSD
ILKLWSRLIKIWTQGRRKKAQAAKR

SEQ ID NO: 207 - protein, 31 aa, Artificial Sequence
  FSD
ILKLWSRLIKIWTQGGSGGGSRRKKAQAAKR

SEQ ID NO: 208 - protein, 25 aa, Artificial Sequence
  FSD
LLKIWSRLIKIWTQGRRLGARAARA

SEQ ID NO: 209 - protein, 31 aa, Artificial Sequence
  FSD
LLKIWSRLIKIWTQGGSGGGSRRKKARAARA

SEQ ID NO: 210 - protein, 26 aa, Artificial Sequence
  FSD
LLKLWSRLIKIWTKGRRKKARAAQAR

SEQ ID NO: 211 - protein, 32 aa, Artificial Sequence
  FSD
LLKLWSRLIKIWTKGGSGGGSRRKKARAAQAR

SEQ ID NO: 212 - protein, 25 aa, Artificial Sequence
  FSD
LLKIWSRLIKIWTQGRRLGARAQAR

SEQ ID NO: 213 - protein, 31 aa, Artificial Sequence
  FSD
LLKIWSRLIKIWTQGGSGGGSRRLGARAQAR

SEQ ID NO: 214 - protein, 27 aa, Artificial Sequence
  FSD
LLKIWSRLIKIWTQGRRLGARAARQAR

SEQ ID NO: 215 - protein, 33 aa, Artificial Sequence
  FSD
LLKIWSRLIKIWTQGRRLGGSGGGSARAARQAR

SEQ ID NO: 216 - protein, 25 aa, Artificial Sequence
  FSD
KLKIWSRLIRKWTKGLRLGAQAQAR

SEQ ID NO: 217 - protein, 31 aa, Artificial Sequence
  FSD
KLKIWSRLIRKWTKGGSGGGSLRLGAQAQAR

SEQ ID NO: 218 - protein, 15 aa, Artificial Sequence
  FSD
LLKIWSRLIKIWTQG

SEQ ID NO: 219 - protein, 21 aa, Artificial Sequence
  FSD
LLKIWSRLIKIWTQGGSGGGS

SEQ ID NO: 220 - protein, 28 aa, Artificial Sequence
  FSD
LLKIWSRLIKIWTQGRGRESRKPRKSRQ

SEQ ID NO: 221 - protein, 34 aa, Artificial Sequence
  FSD
LLKIWSRLIKIWTQGGSGGGSRGRESRKPRKSRQ

SEQ ID NO: 222 - protein, 28 aa, Artificial Sequence
  FSD
LLKIWSRLIKIWTQGLGLLVLRVRAGKR

SEQ ID NO: 223 - protein, 34 aa, Artificial Sequence
  FSD
LLKIWSRLIKIWTQGGSGGGSLGLLVLRVRAGKR

SEQ ID NO: 224 - protein, 29 aa, Artificial Sequence
  FSD
FLHSWKKFLKAFLGRILQSARAGARQARA

SEQ ID NO: 225 - protein, 24 aa, Artificial Sequence
  FSD
FLHLWQKFLKFLSTGRKIGARQAK

SEQ ID NO: 226 - protein, 37 aa, Artificial Sequence
  FSD
HHHHHHFLKIWSRLIKIWTQGRRKGAQAAFRHHHHHH

SEQ ID NO: 227 - protein, 31 aa, Artificial Sequence
  FSD
HHHHHHRFAAQAGKRRGQTWIKILRSWIKLF

SEQ ID NO: 228 - protein, 31 aa, Artificial Sequence
  FSD
HHHHFLHHSWIKKILRTWIRRGQQAGKFAAR

SEQ ID NO: 229 - protein, 37 aa, Artificial Sequence
  FSD
HHHHHHAKARKAKLRRGQTWLKLLRSWLKLLHHHHHH

SEQ ID NO: 230 - protein, 37 aa, Artificial Sequence
  FSD
HHHHLLHHSWLKKLLRTWLRRGQKAKLKARAHHHHHH

SEQ ID NO: 231 - protein, 32 aa, Artificial Sequence
  FSD
HHHHHHRRALLALALHHLAHLALHLALALRRA

SEQ ID NO: 232 - protein, 32 aa, Artificial Sequence
  FSD
HHHHHHKKGLLGLGLHHLGHLGLHLGLGLKKG

SEQ ID NO: 233 - protein, 32 aa, Artificial Sequence
  FSD
HHHHHHKKAIIAIAIHHIAHIAIHIAIAIKKA

SEQ ID NO: 234 - protein, 32 aa, Artificial Sequence
  FSD
HHHHHHKKAVVAVAVHHVAHVAVHVAVAVKKA

SEQ ID NO: 235 - protein, 32 aa, Artificial Sequence
  FSD
HHHHHHKKALLAALLHHLAHLLAHLAAALKKL

SEQ ID NO: 236 - protein, 26 aa, Artificial Sequence
  FSD
HHHHHHGLFKALLKLLKSLWKLLLKA

SEQ ID NO: 237 - protein, 30 aa, Artificial Sequence
  FSD
HHHHHHGLFKALLKLHHLKHSLWHKLLLKA

SEQ ID NO: 238 - protein, 32 aa, Artificial Sequence
  FSD
HHHHHHALALALLKLHHLKHLLAHKLLAKAAA

SEQ ID NO: 239 - protein, 28 aa, Artificial Sequence
  FSD
HHHHHHALLKALAKLLLALAKLLLKAAA

SEQ ID NO: 240 - protein, 31 aa, Artificial Sequence
  FSD
HHHHHHKLKLRSRLKWGRTQLWRALAKKALL

SEQ ID NO: 241 - protein, 32 aa, Artificial Sequence
  FSD
HHHHHHVLKLWSRILKAFTQGRRMAAKRAKCN

SEQ ID NO: 242 - protein, 31 aa, Artificial Sequence
  FSD
HHHHHHLLKLWSRLLKEWTQGRRLEAKRAEA

SEQ ID NO: 243 - protein, 24 aa, Artificial Sequence
  Computer-generated peptide variant
RLKFLRRLMRLIRSGLRVFHRACV

SEQ ID NO: 244 - protein, 36 aa, Artificial Sequence
  Computer-generated peptide variant
RFKLLNRMLRRFRSSALTLVIAVALIMLRWADKLIK

SEQ ID NO: 245 - protein, 67 aa, Artificial Sequence
  Computer-generated peptide variant
FLKLMRKLFKRYRKGKALLKGDLAKRLLKAKAWYMLPLVFHRIRKATIGPLHCRAKMRKRPGRREAR

SEQ ID NO: 246 - protein, 30 aa, Artificial Sequence
  Computer-generated peptide variant
LMKLLQKIYRLLRRKHLKPNRYSCDLLRQH

SEQ ID NO: 247 - protein, 30 aa, Artificial Sequence
  Computer-generated peptide variant
RFKFLQKFYRLYPKRSHNNKAPRLRLVLLA

SEQ ID NO: 248 - protein, 25 aa, Artificial Sequence
  Computer-generated peptide variant
YYKIWQKLLRKLRRKKRSAACAILQ

SEQ ID NO: 249 - protein, 36 aa, Artificial Sequence
  Computer-generated peptide variant
KLRLLRRFYRYIRNPTSLCKAKLIKKWYAVYQAARA

SEQ ID NO: 250 - protein, 34 aa, Artificial Sequence
  Computer-generated peptide variant
KWRWLTKLIRRLPCLGDHLNKQSLAYDRAKSALR

SEQ ID NO: 251 - protein, 57 aa, Artificial Sequence
  Computer-generated peptide variant
LFRMLRKFMRRLRRLSAALFLLKRQQQELFAGVKPLRVSKADVVLKRAFLLARRLDC

SEQ ID NO: 252 - protein, 30 aa, Artificial Sequence
  Computer-generated peptide variant
LLKFLKRWWKLWKKDNRHSAKLTEWDLRLG

SEQ ID NO: 253 - protein, 27 aa, Artificial Sequence
  Computer-generated peptide variant
LLRLMKKLIKRFTNLHLLMKSKRPSAV

SEQ ID NO: 254 - protein, 75 aa, Artificial Sequence
  Computer-generated peptide variant
KWKILRKMLKKIQTRGAFDKLPRARDRKVWTGWLLDQNFWLAKGSKLRLLHKPLASRDRLKAKERHFHEHRALRK

SEQ ID NO: 255 - protein, 44 aa, Artificial Sequence
  Computer-generated peptide variant
LLKFFSKLMKRFKRARHSLILRDAHRKQALWMAWLIVKKKHFLF

SEQ ID NO: 256 - protein, 21 aa, Artificial Sequence
  Computer-generated peptide variant
RIRFMHRLLRRFCKVADKYAA

SEQ ID NO: 257 - protein, 75 aa, Artificial Sequence
  Computer-generated peptide variant
LWRYMKRYLRFLHRRAEITLILQAYIFLHAKRARKRHGLFSAKGKKKEKWMLCHCLQLGLARTKKRALATAKLPP

SEQ ID NO: 258 - protein, 81 aa, Artificial Sequence
  Computer-generated peptide variant
FLKLMTRMYKRLKCDAKKLHKGKHIANKATLLARFAQRLHQYARIKKRRKLWKLKYLPRLKYIKANNAWHLLKRAPWLALR

SEQ ID NO: 259 - protein, 45 aa, Artificial Sequence
  Computer-generated peptide variant
FLKFYSRIFRRFKTFPRFKLRPAGAFLQLRHAKALKRWCRPALLK

SEQ ID NO: 260 - protein, 59 aa, Artificial Sequence
  Computer-generated peptide variant
KLKLIRRFMKKFRTRLAVKIRAWDKAKPYADGLLASLLKRLRVPRCIMCHAKFILTQCK

SEQ ID NO: 261 - protein, 49 aa, Artificial Sequence
  Computer-generated peptide variant
KLKLFNRYLKKLTRADAGLGLWAWSAAKELFLAEWANWKTYYRRLRPNK

SEQ ID NO: 262 - protein, 38 aa, Artificial Sequence
  Computer-generated peptide variant
KFRLFQRWWRRLRTLRANSCRKAASSALCMAWNRGKCA

SEQ ID NO: 263 - protein, 38 aa, Artificial Sequence
  Computer-generated peptide variant
FMKFLKKYFRFYTKCALRAYLHKAHKRLRTRSWILAQR

SEQ ID NO: 264 - protein, 32 aa, Artificial Sequence
  Computer-generated peptide variant
IWKLLRKLLKKLRKEMMLLKSDKPAQHEKLHY

SEQ ID NO: 265 - protein, 43 aa, Artificial Sequence
  Computer-generated peptide variant
KYKYLKRFLKFLRKEETRLLLAANHCYRALKNEFEYRAAKQAR

SEQ ID NO: 266 - protein, 58 aa, Artificial Sequence
  Computer-generated peptide variant
LLRLFRKLFKFLRKGLGEPLLQGNKKLFKDLKLRHSKAALAFMSASFFAGDKLNGRWG

SEQ ID NO: 267 - protein, 56 aa, Artificial Sequence
  Computer-generated peptide variant
YMRLMKRLLKWITTLALDYGRNLPLALRSRAKLPAFWLPIGDARRRKVLRLNYYRV

SEQ ID NO: 268 - protein, 43 aa, Artificial Sequence
  Computer-generated peptide variant
RLRLFRKFYRKFTRRKLCVAKASTFRVLYANRTEARKYTLLLR

SEQ ID NO: 269 - protein, 54 aa, Artificial Sequence
  Computer-generated peptide variant
KLRLIKRFLRFMNKLRVRAVPKKAARKLKEWQAWKTGEAWGDKAAFRLLDLNKC

SEQ ID NO: 270 - protein, 42 aa, Artificial Sequence
  Computer-generated peptide variant
LWKLLKRYFKKMCKLAWKHRKGADPLVLLMMHAKKVLPLSGL

SEQ ID NO: 271 - protein, 33 aa, Artificial Sequence
  Computer-generated peptide variant
LMRFIKRMMKLLTRSLKILGARGKELTRRGRWL

SEQ ID NO: 272 - protein, 36 aa, Artificial Sequence
  Computer-generated peptide variant
KLKMLRKFIKMLPKLLRCRKLRWHCCAKSWHAHLYA

SEQ ID NO: 273 - protein, 31 aa, Artificial Sequence
  Computer-generated peptide variant
KFKFLRRYMKKFKRAGKADDLELLAAWAKAI

SEQ ID NO: 274 - protein, 49 aa, Artificial Sequence
  Computer-generated peptide variant
LMKLFKKMFRKMKRMLWAILLRLREDKAILTKEGLLLNKKRRKRFAAKM

SEQ ID NO: 275 - protein, 68 aa, Artificial Sequence
  Computer-generated peptide variant
KWKFLRRFWKKLKHARAKMRLASRIFNKLRGERCHGAGVFIYRLDFNRPHGHARALRAIALKAAIKRR

SEQ ID NO: 276 - protein, 62 aa, Artificial Sequence
  Computer-generated peptide variant
KIKLYRRFMKRICSKKRADWLLLCKALNEKTYKLKARYAARLAWSTKDKILKFLKAQRRTES

SEQ ID NO: 277 - protein, 46 aa, Artificial Sequence
  Computer-generated peptide variant
FLRMYRKLWKKLKHLKAKQNAAQVLGKKAHALMLRARKLIFRMEFK

SEQ ID NO: 278 - protein, 51 aa, Artificial Sequence
  Computer-generated peptide variant
ILKLFSKLIKRFKRWGACRDKLRRWKGRSPIHCLLIIDKKKARQLARCAAA

SEQ ID NO: 279 - protein, 45 aa, Artificial Sequence
  Computer-generated peptide variant
KLKYLCKILKFFKRKAKRRLLDEAGNMGRALKRVNAVMAAHFDRL

SEQ ID NO: 280 - protein, 23 aa, Artificial Sequence
  Computer-generated peptide variant
KFKLICKLWRWFHQRLATKFLRA

SEQ ID NO: 281 - protein, 79 aa, Artificial Sequence
  Computer-generated peptide variant
WMKMYRRMLRRLHCVLHHILRKRKYFLWRLWKKQYTHRLSEALASALNYLLKRAALEKIVLRNKLKAKLAVNKQYAYAK

SEQ ID NO: 282 - protein, 23 aa, Artificial Sequence
  Computer-generated peptide variant
KLRFLPKLLRLWSRRDLMNLKLR

SEQ ID NO: 283 - protein, 66 aa, Artificial Sequence
  Computer-generated peptide variant
KFRYLCRLLKYMTKTAFDYKLKGLNHKKLFAALKSAVQAYYKRRLVNKLKARANRYKAGADESKLR

SEQ ID NO: 284 - protein, 21 aa, Artificial Sequence
  Computer-generated peptide variant
RIRLLRRYLRLLRKHYSEHHE

SEQ ID NO: 285 - protein, 90 aa, Artificial Sequence
  Computer-generated peptide variant
RFKFIKKYFKYLHKKKHERCMKIWAEYMHRDKSLLADKKKNARAKARRLAYAKTGLPEKPRSAAATRTKGLCDLLCKRRAILAACDAAHY

SEQ ID NO: 286 - protein, 59 aa, Artificial Sequence
  Computer-generated peptide variant
FFRWLKRMFRRMTKRAKCLKAAWKWPNAWAKLLEKIPRCHKGNCLRRLLANKINILLKR

SEQ ID NO: 287 - protein, 35 aa, Artificial Sequence
  Computer-generated peptide variant
RLKFFCKLWRKFRKAKYLLPELPIAARTPLLKYAQ

SEQ ID NO: 288 - protein, 57 aa, Artificial Sequence
  Computer-generated peptide variant
LLRLLKKYFKKMRQDLRSASFPHALAAADKAKKRPIKLNIAKIMLMFRLDHHEAMYL

SEQ ID NO: 289 - protein, 29 aa, Artificial Sequence
  Computer-generated peptide variant
KLKIFRKILRWMRKALLRRLSCGHTVGLA

SEQ ID NO: 290 - protein, 21 aa, Artificial Sequence
  Computer-generated peptide variant
LLRFLCRLLRRWRCAKDLLRW

SEQ ID NO: 291 - protein, 32 aa, Artificial Sequence
  Computer-generated peptide variant
KLRIYPKIWRLFRRRMTVLCELKYVKAAAKLA

SEQ ID NO: 292 - protein, 30 aa, Artificial Sequence
  Computer-generated peptide variant
MLKLIKRLIRKMTRKNFASRKYLQAAATYW

SEQ ID NO: 293 - protein, 100 aa, Artificial Sequence
  Computer-generated peptide variant
RFRYFKRFLRLFKKAFATKPKAKHRIAAGNFTRWRFAAALLAVPLCANDCRLKRNAKPRAQKAWDARWKPFELKCLAKEGIALRMKEHAHTFRPRNKRRQ

SEQ ID NO: 294 - protein, 76 aa, Artificial Sequence
  Computer-generated peptide variant
WFKMFSRLWRKIKRILKAKCWKTHLRLHDRKARACLLLLKRAIWLHYVQMNWLYDLKAPAEDAAPGALLRGKRAMC

SEQ ID NO: 295 - protein, 65 aa, Artificial Sequence
  Computer-generated peptide variant
FLKYLKRLWKMFNRDLAMKARKLAAPKAWMHIACYREPFTQALKMKLLRNLKALTTRWAHRPLKL

SEQ ID NO: 296 - protein, 33 aa, Artificial Sequence
  Computer-generated peptide variant
LMKLMKKFLRMLNTKKAAYQTRCKAARYQTAML

SEQ ID NO: 297 - protein, 55 aa, Artificial Sequence
  Computer-generated peptide variant
KLRFLKRMMRFWRRRKREWTSLAMVRAKLSRWAALAADLVLNFLAALNECAWGVK

SEQ ID NO: 298 - protein, 51 aa, Artificial Sequence
  Computer-generated peptide variant
MLKMYQKLLRRFRRAKPAPKGASGCAFLLVARLWQMRRMKRAKASLVKCPL

SEQ ID NO: 299 - protein, 75 aa, Artificial Sequence
  Computer-generated peptide variant
KIKIWRKYLRRLTQLRSSVWYWIGCHRRAALKLGQKFAKAWRCRALFMLYNRNGQLSALKKKKLAHRKTRRMLFK

SEQ ID NO: 300 - protein, 54 aa, Artificial Sequence
  Computer-generated peptide variant
RMRIYCKLLRKLRRLAWLQRALEKFNYPRFALVIRLALKKKAKQAKRKLLWIRA

SEQ ID NO: 301 - protein, 31 aa, Artificial Sequence
  Computer-generated peptide variant
KLRMFTKLWRLFKRKLAAFTEAKLKCNKKAC

SEQ ID NO: 302 - protein, 95 aa, Artificial Sequence
  Computer-generated peptide variant
LYRMLRRLWKKLRKKIILMLKRTRHREMKCAGAYATKYRILRQAAMMRLIMDLLRLYKALLGLEPFRDLALAKEKNMRAIKNEDAFRQKSFLATC

SEQ ID NO: 303 - protein, 48 aa, Artificial Sequence
  Computer-generated peptide variant
KFKLMRKFLKRFKTVKCGLTGTGALLKLTIQLKSRSRKEWAILLALLC

SEQ ID NO: 304 - protein, 44 aa, Artificial Sequence
  Computer-generated peptide variant
KLRWLHKWFKLMQPMLAADDYQAAARLSKLIRALCCFRKLLKRH

SEQ ID NO: 305 - protein, 67 aa, Artificial Sequence
  Computer-generated peptide variant
KLRLLRRIIRIFKNGENAALRKDNHLGLKGARPMRHRKAKFLLFKTYRDDRLPRTKNVLREALLRRL

SEQ ID NO: 306 - protein, 42 aa, Artificial Sequence
  Computer-generated peptide variant
FLKLLHKIFRFLRKLRDWMACGFKKPLYKAWKKCLRLLKMLR

SEQ ID NO: 307 - protein, 59 aa, Artificial Sequence
  Computer-generated peptide variant
RFRLIKRWLRWLRHLAKYNKDRAKVYATARRWKCWKARWSRLLLQGRCKIKARLWAAAE

SEQ ID NO: 308 - protein, 74 aa, Artificial Sequence
  Computer-generated peptide variant
RFKLWRRIFRRLPSLKFWLKKYEPIAADGVKRWRRPMAAHARLDLLKHAGLRQAAACSKMPRTYAEFRKLKGLA

SEQ ID NO: 309 - protein, 20 aa, Artificial Sequence
  Computer-generated peptide variant
KLRMLHRLIRWWCKKLLKPA

SEQ ID NO: 310 - protein, 34 aa, Artificial Sequence
  Computer-generated peptide variant
IFKILKRLYRMFKKWLLAKYRAALGRAALLKRSK

SEQ ID NO: 311 - protein, 38 aa, Artificial Sequence
  Computer-generated peptide variant
LWRMLHRLMRKLTRCGKVIYKASMAGALRKGLMFRRLQ

SEQ ID NO: 312 - protein, 49 aa, Artificial Sequence
  Computer-generated peptide variant
RLKFFKKMYRRFQKTCKPFGRAQDIKLYLAKALARLHPLTRALKYYMLR

SEQ ID NO: 313 - protein, 35 aa, Artificial Sequence
  Computer-generated peptide variant
FLKWFCKFMKKWKPLALVDMRKALLRVLGNKQKRL

SEQ ID NO: 314 - protein, 51 aa, Artificial Sequence
  Computer-generated peptide variant
LLKLLQRFMKRWKRYLRFRLWLRKQCLIFTEIRLAALLMYAKMEKRWHKKA

SEQ ID NO: 315 - protein, 67 aa, Artificial Sequence
  Computer-generated peptide variant
FLKFMKKLIKILKKAYQDERANATAAREAARLNKGELRKHHFFFIHGKTRALRATRHNRLRTKLNKA

SEQ ID NO: 316 - protein, 59 aa, Artificial Sequence
  Computer-generated peptide variant
KLRMLRKFWRLMCQKADIAYPKWMRALRLRFKLAPLRAAENKVDKILSYKRCLYRQAGK

SEQ ID NO: 317 - protein, 31 aa, Artificial Sequence
  Computer-generated peptide variant
KLRWYRRLLKFLRKRAKTLAKMKKGATLEAY

SEQ ID NO: 318 - protein, 77 aa, Artificial Sequence
  Computer-generated peptide variant
MFKLFPRLLRKLRCLHSNIALKLLRYKNKAKDKLCLAKPWPLLLTKKAAWKMYKKQPKNIESLDQAPRHDLRKYQEL

SEQ ID NO: 319 - protein, 57 aa, Artificial Sequence
  Computer-generated peptide variant
WIRWMNRLLRILRCKKIKLDDPKFFLRPRFLKARTDRASAKLANAMRRKAKIKCAHM

SEQ ID NO: 320 - protein, 23 aa, Artificial Sequence
  Computer-generated peptide variant
RLKLLKKWMKMLKTAYWKVYVLK

SEQ ID NO: 321 - protein, 58 aa, Artificial Sequence
  Computer-generated peptide variant
RFRFLRRLFRRWRQHAARCLCYPHDPAYEKDLMMAAALRLAKRIMCAIRNYALRHLML

SEQ ID NO: 322 - protein, 48 aa, Artificial Sequence
  Computer-generated peptide variant
FLRWWRRMLKKWRCAAKHRAHLKLRMQALFSEHKRARNYLDRQLAMAK

SEQ ID NO: 323 - protein, 20 aa, Artificial Sequence
  Computer-generated peptide variant
KIKFYNRFLRLMRRALVKFL

SEQ ID NO: 324 - protein, 73 aa, Artificial Sequence
  Computer-generated peptide variant
KFKLWNKWLRRLSNKARSKLKCASKWEQAAWCNRAFRASVAGRKTLKANLRGLAELANVALQPRRTKRRAIAR

SEQ ID NO: 325 - protein, 33 aa, Artificial Sequence
  Computer-generated peptide variant
KLRMLPRLIRRLKHARRIANKCRHAPAGVKIRL

SEQ ID NO: 326 - protein, 27 aa, Artificial Sequence
  Computer-generated peptide variant
WLKLLKKIYKIWSTLAFKPKWRRSALK

SEQ ID NO: 327 - protein, 36 aa, Artificial Sequence
  Computer-generated peptide variant
RMRILCRLYRFLQKLMKRARKAIPKFRRLACLTWFY

SEQ ID NO: 328 - protein, 40 aa, Artificial Sequence
  Computer-generated peptide variant
RIRWYKKIWRILRKNLSRLQAKLELKYALGLSELLGRVLR

SEQ ID NO: 329 - protein, 37 aa, Artificial Sequence
  Computer-generated peptide variant
RLKLMRKLLRFWKTLLRRRKARLLKCIGWDLGAAHGR

SEQ ID NO: 330 - protein, 62 aa, Artificial Sequence
  Computer-generated peptide variant
LMRFMRRLMRRFCNALRRTRDRPALRDKKAKEAALLPRVTLNVGFVRKDKLARSVRAEKARR

SEQ ID NO: 331 - protein, 29 aa, Artificial Sequence
  Computer-generated peptide variant
FFRFYQKYLKRIRKNLFLLQAKYKWRDAL

SEQ ID NO: 332 - protein, 30 aa, Artificial Sequence
  Computer-generated peptide variant
RWKYFKKLFKLIKCLTYRLDLKGLRLLFKD

SEQ ID NO: 333 - protein, 34 aa, Artificial Sequence
  Computer-generated peptide variant
KLRYLQKWYKRYSRAYGLMCAKRARHLWPKFANA

SEQ ID NO: 334 - protein, 25 aa, Artificial Sequence
  Computer-generated peptide variant
FFKYLHKLLKLLRCLAQDVKTKRRR

SEQ ID NO: 335 - protein, 49 aa, Artificial Sequence
  Computer-generated peptide variant
KFKWYCRLFRLFKHKWSLLLRELAMLCYLHCAKLAGAACLQRWKKQLVK

SEQ ID NO: 336 - protein, 51 aa, Artificial Sequence
  Computer-generated peptide variant
KMKYMCRLMRKIRTLMPEPFKALALLAYLATRLQELFVRMAARVKRRDLKW

SEQ ID NO: 337 - protein, 40 aa, Artificial Sequence
  Computer-generated peptide variant
RLKIWKRFFKKYRTLNKLISHARLLRWKLGLRLIHGRAGR

SEQ ID NO: 338 - protein, 32 aa, Artificial Sequence
  Computer-generated peptide variant
LFKYYCRMWRLLNKCQALTRKMHRCLIALKAK

SEQ ID NO: 339 - protein, 38 aa, Artificial Sequence
  Computer-generated peptide variant
YFKFMKRLLRKIRKLSRWRMLLRWAAPKADADANLWAI

SEQ ID NO: 340 - protein, 52 aa, Artificial Sequence
  Computer-generated peptide variant
RWRLIRRMFRILSSWKPARQKANLRLRRIHLLLKPRLAKADKLALCPNFSAL

SEQ ID NO: 341 - protein, 47 aa, Artificial Sequence
  Computer-generated peptide variant
MLKLMKRLYKLLKKAQLRRAYIAQPMNCHRRLRLKAQWLDRDAYIKN

SEQ ID NO: 342 - protein, 99 aa, Artificial Sequence
  Computer-generated peptide variant
KYKFFKKIFRLLKKTMAFNALQHKLPHKGAKLLRKNGLRNSRPEKRRRKDKKKTNDFILKAMFKAHAKMHLQELRRTHRAEKARACAAACYLRVFQREQ

SEQ ID NO: 343 - protein, 61 aa, Artificial Sequence
  Computer-generated peptide variant
LIKFLRRLLRKWTSRTCEKAASMHKAMRAFSVATLWLIALVLKYTARAAFLAAIRYRWKNC

SEQ ID NO: 344 - protein, 72 aa, Artificial Sequence
  Computer-generated peptide variant
RLKLLTRMYKYWRKDQARLKVHLHFRRSYLAEKKAMTKQKKVNKHANNTAWKLRLAHLKRATDLMHRAELSS

SEQ ID NO: 345 - protein, 36 aa, Artificial Sequence
  Computer-generated peptide variant
FWKYMKRLMRRYHRKCAKAECRKLMAAMAMYRHLFA

SEQ ID NO: 346 - protein, 58 aa, Artificial Sequence
  Computer-generated peptide variant
YIRFLKKLFKKIRTCDAWPLHTNKLTRLYVAHLVTVRRLRALRRGILTVLKCKLRKLG

SEQ ID NO: 347 - protein, 24 aa, Artificial Sequence
  Computer-generated peptide variant
LLKYWTRFWRWFRRIRLVEARLLK

SEQ ID NO: 348 - protein, 33 aa, Artificial Sequence
  Computer-generated peptide variant
MWRMLSKIYKKLTRASLDLALSRAFAHRRQIAK

SEQ ID NO: 349 - protein, 66 aa, Artificial Sequence
  Computer-generated peptide variant
KWRIMKRMYRRWRCLIKNAAKRKKTKIPKRSALKAAGEANFRRLARAVKIDANDTALLANKPTSMN

SEQ ID NO: 350 - protein, 21 aa, Artificial Sequence
  Computer-generated peptide variant
KWRLLRRLLRMWKTYNFGLCR

SEQ ID NO: 351 - protein, 23 aa, Artificial Sequence
  Computer-generated peptide variant
IFRLFKKFLKKLTHLRMAKLGIQ

SEQ ID NO: 352 - protein, 28 aa, Artificial Sequence
  Computer-generated peptide variant
LLRLLQRLFRRLHQNKEFIAIKAGWRVA

SEQ ID NO: 353 - protein, 70 aa, Artificial Sequence
  Computer-generated peptide variant
RLKWIKKIYKRLTRKIFHRARAILMSCTKNRWDKQDAAKALKKLQRLRNRLLVLGELLKITIAIIYHTAK

SEQ ID NO: 354 - protein, 30 aa, Artificial Sequence
  Computer-generated peptide variant
FWRYFKKFLRFLRRLPAHNLKKLQAARFGC

SEQ ID NO: 355 - protein, 34 aa, Artificial Sequence
  Computer-generated peptide variant
RFKLYRRMLKRICSLGPAIAAARDGHASAFALQR

SEQ ID NO: 356 - protein, 54 aa, Artificial Sequence
  Computer-generated peptide variant
KIRWFQRLLKRLRNAARNLQPLVALDHKQLGRKWLNFPLRLPIIILAATRENRL

SEQ ID NO: 357 - protein, 33 aa, Artificial Sequence
  Computer-generated peptide variant
KLRFLQRFWRLLKRNKTLAKVVRLGLCRPDRNT

SEQ ID NO: 358 - protein, 52 aa, Artificial Sequence
  Computer-generated peptide variant
RFKWMRRIMRKYQKIFRTAWVSCNAAMPAAKGKRGNLAGRKLAAARCAKRLY

SEQ ID NO: 359 - protein, 26 aa, Artificial Sequence
  Computer-generated peptide variant
WMKMLRRYWKRLKRAVAAAAHAGCKD

SEQ ID NO: 360 - protein, 90 aa, Artificial Sequence
  Computer-generated peptide variant
KFKILKRFLRLYTRVSAQYFYLFNAKKMDRFAAVVAIAAKARPNLPRAALHNARKMKGKAKAARSIKWMGKAKTAKSVKAPSRRASSTVR

SEQ ID NO: 361 - protein, 20 aa, Artificial Sequence
  Computer-generated peptide variant
IIKFLCRLMKWFCRALHKKA

SEQ ID NO: 362 - protein, 69 aa, Artificial Sequence
  Computer-generated peptide variant
RLRYMNRFYKRLRKRRILATLCWFKFKHAENLKRKQTSYCALEEEKRLQHTLALLQAAVRVLRVRRKAR

SEQ ID NO: 363 - protein, 28 aa, Artificial Sequence
  Computer-generated peptide variant
LLKLMKRYYRWLRQAFAAKLMPARYKSA

SEQ ID NO: 364 - protein, 40 aa, Artificial Sequence
  Computer-generated peptide variant
FMKYLKRMMKLFHRWRYRKFELWLLRPKMLKLMRMPVKAA

SEQ ID NO: 365 - protein, 23 aa, Artificial Sequence
  Computer-generated peptide variant
LMRFYNKYYKKLRKEGLLWLCKA

SEQ ID NO: 366 - protein, 21 aa, Artificial Sequence
  Computer-generated peptide variant
KFKYYRRLYRRFSTLASAHLA

SEQ ID NO: 367 - protein, 41 aa, Artificial Sequence
  Computer-generated peptide variant
FMRYINKYLRYLKKLARASILAHRPFKADCKEGKYLALLRK

SEQ ID NO: 368 - protein, 26 aa, Artificial Sequence
  Computer-generated peptide variant
LLKWYRRFLKRIQTKFALKCISASAR

SEQ ID NO: 369 - protein, 49 aa, Artificial Sequence
  Computer-generated peptide variant
RYRLLKRFWKFFHRRKLRGPLAERKALIIGLAKQSESAKIAPAAKELAM

SEQ ID NO: 370 - protein, 100 aa, Artificial Sequence
  Computer-generated peptide variant
LFRIYKRIMRLMRKAARMRQLLDLSWQFARWFDVGIAKDLRRRPMAALRLLALLKTCYHRTQMQWNAVVHKKKRAKRQQKHRTKATMCCLRLAALAAERV

SEQ ID NO: 371 - protein, 74 aa, Artificial Sequence
  Computer-generated peptide variant
KIRWIRRLLKKLKKLGFAAWEWINLRAKTLALARYQRLAQAGLAMKQNRFAQSCRLMKFWCAFMFLQRVRKEKY

SEQ ID NO: 372 - protein, 41 aa, Artificial Sequence
  Computer-generated peptide variant
YYKFLRKMWKKLKHYRRLLGVRETPLKVYRALARTCKLKQA

SEQ ID NO: 373 - protein, 48 aa, Artificial Sequence
  Computer-generated peptide variant
IFRLIRRYYRRWSKRKPLKAQLRKLAKLCMALLWWIRLAGLVRRILGR

SEQ ID NO: 374 - protein, 39 aa, Artificial Sequence
  Computer-generated peptide variant
RYKYLNKILRRLRNKAAHIVWKCMKFLAKRGDLLGRLQS

SEQ ID NO: 375 - protein, 52 aa, Artificial Sequence
  Computer-generated peptide variant
YWKLWNRFLRKFNKRARLPLKKDMKAKRHDRLLDELTARAGAHKHSHYLALV

SEQ ID NO: 376 - protein, 82 aa, Artificial Sequence
  Computer-generated peptide variant
KFRLLCRFMKRFKRKCTNWYKESAALMRTAKLFPKARRKLATFRRLGHKVAANGGLKPHLCRRRASNRLVAAPVCAAHMQRR

SEQ ID NO: 377 - protein, 60 aa, Artificial Sequence
  Computer-generated peptide variant
LYKLFNKLLRMLKKMRLCYKCDVPARHLRQRGTSKTALFKSRLKETRKAALRSAWLYCRQ

SEQ ID NO: 378 - protein, 71 aa, Artificial Sequence
  Computer-generated peptide variant
RLKLLQRWIRRMRKARHDCLFLKAEAPLDRTSTRAAACWELAKWKNNYCAAYKARKNAQVGKSAAAIAQNR

SEQ ID NO: 379 - protein, 21 aa, Artificial Sequence
  Computer-generated peptide variant
RLKYWSKLFKFYKRYAKAYAI

SEQ ID NO: 380 - protein, 46 aa, Artificial Sequence
  Computer-generated peptide variant
ILKFLKKIIKKLNTVLAAGRLKRAKKAKAKIKLLAVKCFDRNKSNA

SEQ ID NO: 381 - protein, 41 aa, Artificial Sequence
  Computer-generated peptide variant
RLKMFTKLYRRMKNLDPKCKAACRVIHAAKRHALARYLAFK

SEQ ID NO: 382 - protein, 41 aa, Artificial Sequence
  Computer-generated peptide variant
FFKFFRKLFRLLRKIAEANELAGKGRKWALRWARSKRKAGG

SEQ ID NO: 383 - protein, 38 aa, Artificial Sequence
  Computer-generated peptide variant
KWRYMRKILRFLHNQRAFLWLILFHALGRKWKGKAARK

SEQ ID NO: 384 - protein, 22 aa, Artificial Sequence
  Computer-generated peptide variant
LLRLLQRYMKRLKKDGAITIMK

SEQ ID NO: 385 - protein, 61 aa, Artificial Sequence
  Computer-generated peptide variant
KLKFLRRFLKFFPKQLKDLASNYRLLRKTHDRELLKIPFCQALKSANYKKRKKEKVKWQAL

SEQ ID NO: 386 - protein, 36 aa, Artificial Sequence
  Computer-generated peptide variant
IMRYYKRLFKILRKRRKALLKRHKAAYLSAAAQLHC

SEQ ID NO: 387 - protein, 35 aa, Artificial Sequence
  Computer-generated peptide variant
FLRYMKRLWKFMRQIDWDSARAKHKLKLMLAVKLK

SEQ ID NO: 388 - protein, 31 aa, Artificial Sequence
  Computer-generated peptide variant
LIKYYRKFLKKFKRDRITQLGVALLLAAEIA

SEQ ID NO: 389 - protein, 54 aa, Artificial Sequence
  Computer-generated peptide variant
FYRFMKRLLKRYRKDAKLSLRFRLRALEAMYAHVARRPIATTATKACAVTKFLA

SEQ ID NO: 390 - protein, 37 aa, Artificial Sequence
  Computer-generated peptide variant
WFKILKKFIRLLHPRRRIARATNAQLMGIAKEARLLY

SEQ ID NO: 391 - protein, 27 aa, Artificial Sequence
  Computer-generated peptide variant
KLKLFTRFYKILKQDSLAWKRFMLLAR

SEQ ID NO: 392 - protein, 55 aa, Artificial Sequence
  Computer-generated peptide variant
LFRFLPKMLRLYTKPRSDALGAGTYKLLKRTKHFYASLGCAKLAARQLLFRKTLP

SEQ ID NO: 393 - protein, 77 aa, Artificial Sequence
  Computer-generated peptide variant
ILRFIRRFLKKFSRTRVRGRLDAHALLAWLRYELSKQTRRGQYRLRIFKAHQFRCPKKKLLFFRPARQKAMKSLTLR

SEQ ID NO: 394 - protein, 37 aa, Artificial Sequence
  Computer-generated peptide variant
KIKYLTRLFKKFKQAAKNFKARTYALKAACNRPAPNM

SEQ ID NO: 395 - protein, 55 aa, Artificial Sequence
  Computer-generated peptide variant
RMKLFKKLLKRFKPLFSWRGLCAARRLASTICILKRLCNRQGGAAWKAKRARRSP

SEQ ID NO: 396 - protein, 39 aa, Artificial Sequence
  Computer-generated peptide variant
LLRILSRLLRKFRKDKIRLSVKRLQLRALVKDVEAGRAQ

SEQ ID NO: 397 - protein, 32 aa, Artificial Sequence
  Computer-generated peptide variant
RLRMFKRYLRKIKRLRALKDHAMLYTARMPSA

SEQ ID NO: 398 - protein, 55 aa, Artificial Sequence
  Computer-generated peptide variant
RFRYIKRLWRLLKKHSIKKLATMLCAEKPDKLWGLRKSEGLLAALMCLTDELLIA

SEQ ID NO: 399 - protein, 53 aa, Artificial Sequence
  Computer-generated peptide variant
RLKLFKRLLRLLQRLSWAQRRAALKPQCRISTMTAQDKRLPPAFKICDRAAAT

SEQ ID NO: 400 - protein, 24 aa, Artificial Sequence
  Computer-generated peptide variant
RYKLITRFLKKFCSHKLAIALRSK

SEQ ID NO: 401 - protein, 42 aa, Artificial Sequence
  Computer-generated peptide variant
RLKFMKKLLKFYRRRKAKQLLAWEQCLIMVRDRILLPRRLLY

SEQ ID NO: 402 - protein, 49 aa, Artificial Sequence
  Computer-generated peptide variant
FWRLLKRFIRYLTSMYEAIARRKAKRAERLMIARLKELLSIWRKHEWRK

SEQ ID NO: 403 - protein, 65 aa, Artificial Sequence
  Computer-generated peptide variant
LLKYWKKFYRIITRSCRAGKWRKPHARLYFLAALKAQWAWRKMRLILGLKELAGRMEAMSGSARR

SEQ ID NO: 404 - protein, 25 aa, Artificial Sequence
  Computer-generated peptide variant
FLRLIKRLLRMLTRRAARIRTYGHE

SEQ ID NO: 405 - protein, 28 aa, Artificial Sequence
  Computer-generated peptide variant
LIKLFKRILKMLKTNAHLAKRVLSKFSC

SEQ ID NO: 406 - protein, 24 aa, Artificial Sequence
  Computer-generated peptide variant
LFRIIQKYLRRLCRLAQRRSAHPR

SEQ ID NO: 407 - protein, 47 aa, Artificial Sequence
  Computer-generated peptide variant
RIKLMRRFYKRLSKESAFVHMLVRLAKRLLAMLTDWLVGRAKAADTC

SEQ ID NO: 408 - protein, 29 aa, Artificial Sequence
  Computer-generated peptide variant
KMKLLTRLMKFFRNAWFKHYKALLAFARY

SEQ ID NO: 409 - protein, 41 aa, Artificial Sequence
  Computer-generated peptide variant
RFKLYKRLYRKFTTKIKRTAMKAHLVDRSLVCFLLRDRAAA

SEQ ID NO: 410 - protein, 33 aa, Artificial Sequence
  Computer-generated peptide variant
KYRFLRKLLRIFKKCWDKSGAAIVKAHRAAAWH

SEQ ID NO: 411 - protein, 24 aa, Artificial Sequence
  Computer-generated peptide variant
KFKWYTRLLRKLKPWHADARKAMW

SEQ ID NO: 412 - protein, 25 aa, Artificial Sequence
  Computer-generated peptide variant
IMKFWKRFLKRMTPHALAMAHAARA

SEQ ID NO: 413 - protein, 75 aa, Artificial Sequence
  Computer-generated peptide variant
KMRLWKKFYKILQCDYLSNRLKREYCALLLQKKMAGALAPRRWLPLKLVSKVSAQKDLQRRADDKGRSLALRSLD

SEQ ID NO: 414 - protein, 27 aa, Artificial Sequence
  Computer-generated peptide variant
LLRIFNKMLRRMKHRHLYCRWAYRLAY

SEQ ID NO: 415 - protein, 21 aa, Artificial Sequence
  Computer-generated peptide variant
LLRLFKRLWRRMRPLADRIIA

SEQ ID NO: 416 - protein, 20 aa, Artificial Sequence
  Computer-generated peptide variant
RLKLWPKYLKRWHKMFTKAA

SEQ ID NO: 417 - protein, 27 aa, Artificial Sequence
  Computer-generated peptide variant
LMKMLSKFLRKWKPLLTAFYKGEWLKL

SEQ ID NO: 418 - protein, 30 aa, Artificial Sequence
  Computer-generated peptide variant
LFKLIRRYFKKWRTVCFKAHRAELALKRSW

SEQ ID NO: 419 - protein, 46 aa, Artificial Sequence
  Computer-generated peptide variant
MLRIYCRFFKLFRPTCLRRKLQKKLQCKSSGRKARALARCAACLNG

SEQ ID NO: 420 - protein, 22 aa, Artificial Sequence
  Computer-generated peptide variant
RIRLYCRLLRRLSKLKCRLLYK

SEQ ID NO: 421 - protein, 82 aa, Artificial Sequence
  Computer-generated peptide variant
KLRYLCRFMRKYRRAKHLTEARAWTKMLARLLRRKLTSHHGLNLSSRTLKAKARTETKKAKCLRLNNYGRELGSDVKRYFCR

SEQ ID NO: 422 - protein, 48 aa, Artificial Sequence
  Computer-generated peptide variant
KFKLMRKLFKKFKQAVLTGTLKGKKLALNWLQCEYRLCKTRFLLKRVT

SEQ ID NO: 423 - protein, 30 aa, Artificial Sequence
  Computer-generated peptide variant
LMRLYKKLFRRMKKAKLKFCFVKDPNGALC

SEQ ID NO: 424 - protein, 41 aa, Artificial Sequence
  Computer-generated peptide variant
KMKLFPRLFKFFCRLAKSCCHRARRFEAKLAAREQNKRPYL

SEQ ID NO: 425 - protein, 34 aa, Artificial Sequence
  Computer-generated peptide variant
WFRFLKKYLRKLRHFFCFKKMAMSVALTRLRAKL

SEQ ID NO: 426 - protein, 58 aa, Artificial Sequence
  Computer-generated peptide variant
ILKLFPRLLRLLHQKKWYKEALKLKWKAKVMKRWRYFAHDAKMAARNNNPKMSKMLYK

SEQ ID NO: 427 - protein, 21 aa, Artificial Sequence
  Computer-generated peptide variant
KIKYLKKLMRKLKNWAVAQQF

SEQ ID NO: 428 - protein, 31 aa, Artificial Sequence
  Computer-generated peptide variant
KMRLFKKLMRRLNQRRGRCRYLTRAAAKALS

SEQ ID NO: 429 - protein, 25 aa, Artificial Sequence
  Computer-generated peptide variant
MLKFWRKYLRRLRRTDWERLLWASV

SEQ ID NO: 430 - protein, 27 aa, Artificial Sequence
  Computer-generated peptide variant
MLRLLKKLLKKLPKNAETKGMKGTDQP

SEQ ID NO: 431 - protein, 24 aa, Artificial Sequence
  Computer-generated peptide variant
KYRMLRKLIRKICPLKTALLKARH

SEQ ID NO: 432 - protein, 33 aa, Artificial Sequence
  Computer-generated peptide variant
LYRWYKRWWKFLSCYSHWKLKGLLAKDAKKLAR

SEQ ID NO: 433 - protein, 40 aa, Artificial Sequence
  Computer-generated peptide variant
RLKLLKKLIRKWKHLWKHRESDMAFDAYLHSSAWKLTLGR

SEQ ID NO: 434 - protein, 27 aa, Artificial Sequence
  Computer-generated peptide variant
KFKIWKRIFKRINHLTLAASLPAAVRK

SEQ ID NO: 435 - protein, 67 aa, Artificial Sequence
  Computer-generated peptide variant
KFRLLPKLLKKISKKYYAIRVACAAELWLLAQRPLPDKQSKRNRRTAKACFSYKDAYDAAKDRWFGR

SEQ ID NO: 436 - protein, 34 aa, Artificial Sequence
  Computer-generated peptide variant
KMKLLNRLLKKWRKAVVVAMDASWWVKRLNYEKK

SEQ ID NO: 437 - protein, 52 aa, Artificial Sequence
  Computer-generated peptide variant
IWRMIKRMLRLYKRHAANPRKLWKLITLAVQAAHQLVLALFRFQRRHRWALK

SEQ ID NO: 438 - protein, 39 aa, Artificial Sequence
  Computer-generated peptide variant
YFRFFRKMLKRWKPRALNALTAARRRKLCYRPEAQAILK

SEQ ID NO: 439 - protein, 20 aa, Artificial Sequence
  Computer-generated peptide variant
KLKFIRKWLRKFQKLIDPLA

SEQ ID NO: 440 - protein, 45 aa, Artificial Sequence
  Computer-generated peptide variant
LFKWMKKLLRIWNKNRRLARLAMQNPPARLTKRACKIKQLNRAQY

SEQ ID NO: 441 - protein, 23 aa, Artificial Sequence
  Computer-generated peptide variant
RIKFLRRLMRKLRCNLDTLLAAE

SEQ ID NO: 442 - protein, 41 aa, Artificial Sequence
  Computer-generated peptide variant
RLRLWHKYWRKLRSLAKECQFCFKLAAAAKDPTRPERRIRK

SEQ ID NO: 443 - protein, 46 aa, Artificial Sequence
  Computer-generated peptide variant
RFKLLCKLFRKMRKRATSKTAAAMLKLKRDYIWAGFTAPDIASLRL

SEQ ID NO: 444 - protein, 46 aa, Artificial Sequence
  Computer-generated peptide variant
LLRMMHRWLKKLSRWLLTTKARLMPCIDTPLKYRALTDAARVASKR

SEQ ID NO: 445 - protein, 41 aa, Artificial Sequence
  Computer-generated peptide variant
LWRFFQKFLRLFHRMRGGLARLRQKALILHLRTDRKAYALR

SEQ ID NO: 446 - protein, 36 aa, Artificial Sequence
  Computer-generated peptide variant
FMRLLKKLLRFFHRWKKLLLMLKLCKEARAFAMDPS

SEQ ID NO: 447 - protein, 50 aa, Artificial Sequence
  Computer-generated peptide variant
LFKWFKRLLKRYRRRDRKYHSTKLRLASWDFALSCLRRKGHAEHTSAVKA

SEQ ID NO: 448 - protein, 22 aa, Artificial Sequence
  Computer-generated peptide variant
RLKFLRKFYKRLHRLYFAAWLR

SEQ ID NO: 449 - protein, 67 aa, Artificial Sequence
  Computer-generated peptide variant
KLRMLHKFFRYIRQKPAYYKLAERFHPSLVHAEPARYKAAKKADLNADKQRVKLAEQKDKACVARLA

SEQ ID NO: 450 - protein, 32 aa, Artificial Sequence
  Computer-generated peptide variant
KMKFIKKMLKLLRRAKLWRPPLVDTPQGRLLE

SEQ ID NO: 451 - protein, 49 aa, Artificial Sequence
  Computer-generated peptide variant
LWRFLNKMLKMLSRLRARRRQRCDLQMLWHLLQLKAQTKAKTFWHTGAA

SEQ ID NO: 452 - protein, 85 aa, Artificial Sequence
  Computer-generated peptide variant
RFKLMPRLMKRIQKRKACIYAKMWFLAHVTMDAARRLAMRVKYFPLHDHKLSSKCARPIKCHRILEAKQLKALYRRLKRLTANKR

SEQ ID NO: 453 - protein, 24 aa, Artificial Sequence
  Computer-generated peptide variant
LLKLLNKMLKIYTTRMQAVAAIRR

SEQ ID NO: 454 - protein, 28 aa, Artificial Sequence
  Computer-generated peptide variant
RLRFFKKFLRKMKRKADALAQILYASHD

SEQ ID NO: 455 - protein, 40 aa, Artificial Sequence
  Computer-generated peptide variant
RFKFLKRWLKRLQKLAQLLVQKDAGQQSPRWLKHGLSARP

SEQ ID NO: 456 - protein, 57 aa, Artificial Sequence
  Computer-generated peptide variant
LLRWLNRLFKRLKCCKRSYYFRELKRLDRARILPRTRRVILRALHMPFCAWKDIGAR

SEQ ID NO: 457 - protein, 39 aa, Artificial Sequence
  Computer-generated peptide variant
LWRFLRRLMRFLKRTGLFQRNNLLFAKHKPRARNFRLLI

SEQ ID NO: 458 - protein, 56 aa, Artificial Sequence
  Computer-generated peptide variant
FFRMIKRFLKMLKQLAEWKRNGAFKAAAKALREKTKAPYRARTARLKHCRIRRVRL

SEQ ID NO: 459 - protein, 38 aa, Artificial Sequence
  Computer-generated peptide variant
LIRLYRRFFKIFRKRAKLVGCYAASLHFTEPRLRRKLF

SEQ ID NO: 460 - protein, 21 aa, Artificial Sequence
  Computer-generated peptide variant
MLKLLRKWMRRMQNLAYKCLT

SEQ ID NO: 461 - protein, 30 aa, Artificial Sequence
  Computer-generated peptide variant
RLRMLRRLFRRLSRVCRLERATAQHPYLQR

SEQ ID NO: 462 - protein, 21 aa, Artificial Sequence
  Computer-generated peptide variant
FWRLFNRLFKKFKTANRCKAA

SEQ ID NO: 463 - protein, 42 aa, Artificial Sequence
  Computer-generated peptide variant
FLKLYPKILRLLRTAENPALLDALLDIRKNKIQNKRRTKRCK

SEQ ID NO: 464 - protein, 69 aa, Artificial Sequence
  Computer-generated peptide variant
FMRLLTRWYKWLRNYSLKAEGRLRRQPAKMLDKCWKLNTRRHIHKSRAWKRLVRAYLKLHPHKATAAKY

SEQ ID NO: 465 - protein, 37 aa, Artificial Sequence
  Computer-generated peptide variant
RLRLLCKWFRKLKPLQLVLWTRALWRIKRAYNAICYF

SEQ ID NO: 466 - protein, 70 aa, Artificial Sequence
  Computer-generated peptide variant
RLKYLKRFYRKFQCKKAMRHRATRLARAEPRDALPRLALPVTKLHAANEMFDERLCWRKKRKDFAMLKKM

SEQ ID NO: 467 - protein, 56 aa, Artificial Sequence
  Computer-generated peptide variant
RLKLLCKWLRMMKTARASMAACLSMSWDVKANVGLRQRTGLKARKCELKKLACALA

SEQ ID NO: 468 - protein, 60 aa, Artificial Sequence
  Computer-generated peptide variant
KFKMLNRYIKRLPRAPRLAKKLAEFVMDRTLETDNAKKYGMTLLLSDCNAALDGLALLRK

SEQ ID NO: 469 - protein, 35 aa, Artificial Sequence
  Computer-generated peptide variant
RLRLIRRFFRWFRKRTLPLRDHFKLMYARAWAAYA

SEQ ID NO: 470 - protein, 71 aa, Artificial Sequence
  Computer-generated peptide variant
RLRMYKRMWRKLRKCDSAYFLKYWNKKPLKVKRAWLATWAANLAIQPVCAKCRRDGNMKRRWLMAKLIRRL

SEQ ID NO: 471 - protein, 44 aa, Artificial Sequence
  Computer-generated peptide variant
RLKFIKRFWKRYHRMPRIAALRDFKANAFAAHKKRLKMGDFCAA

SEQ ID NO: 472 - protein, 37 aa, Artificial Sequence
  Computer-generated peptide variant
RMKLMCRYLRRLCCTIKKTLLLDLCREANLLATLAKK

SEQ ID NO: 473 - protein, 34 aa, Artificial Sequence
  Computer-generated peptide variant
RFRYWQKLFRRLRREAAVNMATLLSAGMEKLEAA

SEQ ID NO: 474 - protein, 28 aa, Artificial Sequence
  Computer-generated peptide variant
YLRLMRKLMRFLRSEKACTWKAHKKALA

SEQ ID NO: 475 - protein, 56 aa, Artificial Sequence
  Computer-generated peptide variant
FFRLLKKMLRILSKALLPKESKKIKDNETLRSRCQLAVLRRALDSKFWRAYLLNTR

SEQ ID NO: 476 - protein, 26 aa, Artificial Sequence
  Computer-generated peptide variant
RFRFIRKLLRRLKQWDLNLQPLFLNA

SEQ ID NO: 477 - protein, 33 aa, Artificial Sequence
  Computer-generated peptide variant
KFRLIKKLLRLLRRDKALNVQILMCRSEFRDAR

SEQ ID NO: 478 - protein, 42 aa, Artificial Sequence
  Computer-generated peptide variant
KYKYYRRFIRKLHHVKKLRDEHDAAVRALPKLLAQRLWARAW

SEQ ID NO: 479 - protein, 45 aa, Artificial Sequence
  Computer-generated peptide variant
RIRFLKRILRRWRHLCILHALAAHKPPTLAYKWKVWPKAYDLLKK

SEQ ID NO: 480 - protein, 62 aa, Artificial Sequence
  Computer-generated peptide variant
KYKLFPRFLKFLQNRSHLWNERDALAAKPVKWRKKEALVWEQGANLRLDRKKAWAARQCKKK

SEQ ID NO: 481 - protein, 67 aa, Artificial Sequence
  Computer-generated peptide variant
FMKIICKFMKWFKNKLVLMLLLIRESIPAGYLDFKFAYLMKLARKHPKRRRLFRRKLKAFAAMKAAD

SEQ ID NO: 482 - protein, 30 aa, Artificial Sequence
  Computer-generated peptide variant
RLRLFKKYIKKWRKAFCVAFRGALLLRKSL

SEQ ID NO: 483 - protein, 55 aa, Artificial Sequence
  Computer-generated peptide variant
LYRLLCRWMRRLKPKDHADEALLIKQKDKNKKCFALVLKLLLSHLKGKHPDVAGR

SEQ ID NO: 484 - protein, 20 aa, Artificial Sequence
  Computer-generated peptide variant
KWKLYHKILRRWKTAAAEEL

SEQ ID NO: 485 - protein, 21 aa, Artificial Sequence
  Computer-generated peptide variant
RIRLLQRIFKLFCRGRRATLV

SEQ ID NO: 486 - protein, 36 aa, Artificial Sequence
  Computer-generated peptide variant
RWRMWHRLWRYLKCLVKRQRKNWLALAKAKRWQEDA

SEQ ID NO: 487 - protein, 38 aa, Artificial Sequence
  Computer-generated peptide variant
IYRLIQKLMKRLQHLSNKLQRKLAKARLAAAICARKIY

SEQ ID NO: 488 - protein, 46 aa, Artificial Sequence
  Computer-generated peptide variant
YLRLLKKLYRLLRPAKEMKKLTLRKLKRIYKIKPNRALTMLSSKRD

SEQ ID NO: 489 - protein, 69 aa, Artificial Sequence
  Computer-generated peptide variant
LIKFFKKMLRKLRPFQRLAKRRLLAASNKFEAELIWSKHDKLDGPKKRGRHMYKLLMVRRSQLSKIASA

SEQ ID NO: 490 - protein, 30 aa, Artificial Sequence
  Computer-generated peptide variant
RLKLLKRLMRLYKHLQWQLACYRMKYYKPT

SEQ ID NO: 491 - protein, 63 aa, Artificial Sequence
  Computer-generated peptide variant
MLKWWQRFLKLIHKRQLKALDARIKWCNRLRARAACGAYRAALQPELRQVMAEDAFWMAARRE

SEQ ID NO: 492 - protein, 23 aa, Artificial Sequence
  Computer-generated peptide variant
KFKYYRKLFRRLSRAKARELALQ

SEQ ID NO: 493 - protein, 36 aa, Artificial Sequence
  Computer-generated peptide variant
LLRIWKKFMKLFCKHQELAERAKSTRKMRYVLAMRL

SEQ ID NO: 494 - protein, 32 aa, Artificial Sequence
  Computer-generated peptide variant
IIRLFRKLLRRLCRHARPVKRTANVELKLKMS

SEQ ID NO: 495 - protein, 34 aa, Artificial Sequence
  Computer-generated peptide variant
FFRLLRRYFKLFKRRMSTLKKVAMSTAANLLAQL

SEQ ID NO: 496 - protein, 22 aa, Artificial Sequence
  Computer-generated peptide variant
LFKYYRRIFKLLKNANQRGAKL

SEQ ID NO: 497 - protein, 36 aa, Artificial Sequence
  Computer-generated peptide variant
LYRMWKRLIRKLHRQDKKWALGARVDAKKMCGEALK

SEQ ID NO: 498 - protein, 20 aa, Artificial Sequence
  Computer-generated peptide variant
RFKYYSRLYRFLRRLLNLIQ

SEQ ID NO: 499 - protein, 24 aa, Artificial Sequence
  Computer-generated peptide variant
RMRLYKRLWRFLKPHLPAMLERLV

SEQ ID NO: 500 - protein, 55 aa, Artificial Sequence
  Computer-generated peptide variant
LYRFFKRLIRRLPTWMLCMVAAYLLLRRRRSCKFIKARLPDLSAMSPRLKRLDAR

SEQ ID NO: 501 - protein, 40 aa, Artificial Sequence
  Computer-generated peptide variant
KIRFLKRLIKKFNTVSAGLLLKRYKLLLGMPKAQRLLAAM

SEQ ID NO: 502 - protein, 27 aa, Artificial Sequence
  Computer-generated peptide variant
RIRFLTRWFKLIKRKLLALLLQAQWYH

SEQ ID NO: 503 - protein, 35 aa, Artificial Sequence
  Computer-generated peptide variant
KLRLYKKYLRFMRKFARDLLAKEFKLSRNNALCMF

SEQ ID NO: 504 - protein, 58 aa, Artificial Sequence
  Computer-generated peptide variant
KFKFLSRFLKRLRRNMAIAAFLMMKSAGMRYKAECKWKCLDERMLRMALSAAPYRKLR

SEQ ID NO: 505 - protein, 44 aa, Artificial Sequence
  Computer-generated peptide variant
LLRFLNRLFKRIRKEAAQLYKRLYIKKKRPQKAHLEGYRDMGWL

SEQ ID NO: 506 - protein, 26 aa, Artificial Sequence
  Computer-generated peptide variant
KYKFFQKMFKRLQKARLELRRRLAAL

SEQ ID NO: 507 - protein, 24 aa, Artificial Sequence
  Computer-generated peptide variant
KWRYLCRMFRKLCSRLHRPALATL

SEQ ID NO: 508 - protein, 62 aa, Artificial Sequence
  Computer-generated peptide variant
LLKLFRKILKRLRSIKKAAVHCAIATLEASARRAEANAWKNTSTAATEKARLRVMKLLEAKW

SEQ ID NO: 509 - protein, 52 aa, Artificial Sequence
  Computer-generated peptide variant
LYKLLRKILRKFKKYLAMPRFHAGARADPLRLKRRSPGLQFSEKKRMLTTMY

SEQ ID NO: 510 - protein, 57 aa, Artificial Sequence
  Computer-generated peptide variant
FLRILKRLYRFIRRAANWKKLQLLAMADTRAVRWCRAVRFPVCAIKPKKRARKQMFE

SEQ ID NO: 511 - protein, 26 aa, Artificial Sequence
  Computer-generated peptide variant
LLKFLRRFLRFYKCPNLAKKESKKWA

SEQ ID NO: 512 - protein, 31 aa, Artificial Sequence
  Computer-generated peptide variant
KMKFLRKLYRRWKRILAAMVKLLTLKCQGLQ

SEQ ID NO: 513 - protein, 74 aa, Artificial Sequence
  Computer-generated peptide variant
RFKIFNRMLKRFRNALKAAKFEAWMHLLRLRQWNLHADTIKAFRLTLRPKDALPQELRKLGTSQLKRAQAALKM

SEQ ID NO: 514 - protein, 46 aa, Artificial Sequence
  Computer-generated peptide variant
RFKMLRRLLRMLNPNAALTRSLTQKWQAALQRKALRRKPRRDYIPP

SEQ ID NO: 515 - protein, 46 aa, Artificial Sequence
  Computer-generated peptide variant
RYRWMQRIFKYLRSAKLTCHYRLKAPKVDCRYLALKLQLRLPAALD

SEQ ID NO: 516 - protein, 27 aa, Artificial Sequence
  Computer-generated peptide variant
MYKMLKKFIKRLHPKLHLWLKFKALVR

SEQ ID NO: 517 - protein, 44 aa, Artificial Sequence
  Computer-generated peptide variant
KLRWICRLLRRMRNLNIDMAIVRLLATVKSDKRYIKTKARKARA

SEQ ID NO: 518 - protein, 34 aa, Artificial Sequence
  Computer-generated peptide variant
LLRMYRKLYRKWKRLAHKLKMAPCNWLVCHRAVC

SEQ ID NO: 519 - protein, 37 aa, Artificial Sequence
  Computer-generated peptide variant
RFRLFSRFWKRLTSSWLLAKCAARKAVLYGVRLAARW

SEQ ID NO: 520 - protein, 54 aa, Artificial Sequence
  Computer-generated peptide variant
KLRFLQRFYKLIKRAWRLKALGLLKRCPGAPEKDRLEIVARLLVALCFRHKAPL

SEQ ID NO: 521 - protein, 43 aa, Artificial Sequence
  Computer-generated peptide variant
RMKFLRRILRKYHPTQDRRASNSRATSHRDLLLLLKACLCAYR

SEQ ID NO: 522 - protein, 57 aa, Artificial Sequence
  Computer-generated peptide variant
KLKFLCRFIRRWTRFLPQKYAYDAALANEARAPAMQARRNKQLVKNKWAATEYRARL

SEQ ID NO: 523 - protein, 92 aa, Artificial Sequence
  Computer-generated peptide variant
LWKYYRRMLRKFKCRELKLAWDQLWPRCKRPYAVTKIVKEQSRGAAVLIANALLKPLLLCGLARKYRADACQKHRGRTLDRHKLARLEAPEA

SEQ ID NO: 524 - protein, 31 aa, Artificial Sequence
  Computer-generated peptide variant
RLKLLKRYFRLLKKKTGRVWAWKYACHANNH

SEQ ID NO: 525 - protein, 40 aa, Artificial Sequence
  Computer-generated peptide variant
LFRLLKKLLRWMTRQKKAAKPADKLLKLFLDKGVHNRILI

SEQ ID NO: 526 - protein, 24 aa, Artificial Sequence
  Computer-generated peptide variant
RFKLMRRLIRLMKNCNKAHREATA

SEQ ID NO: 527 - protein, 23 aa, Artificial Sequence
  Computer-generated peptide variant
RMKIFKRLLKRFSPLILRLSCAY

SEQ ID NO: 528 - protein, 45 aa, Artificial Sequence
  Computer-generated peptide variant
LMRLYHKLFRKFKPTLRADKKNARPKAMRYMSDLCYLFARWRLKK

SEQ ID NO: 529 - protein, 50 aa, Artificial Sequence
  Computer-generated peptide variant
FIRWYTKLWRFLRREAKPREALHEKKAANRARISACKACADHKRKFAKAM

SEQ ID NO: 530 - protein, 22 aa, Artificial Sequence
  Computer-generated peptide variant
LFRWLRRYLRRYTHAYLRCLLH

SEQ ID NO: 531 - protein, 32 aa, Artificial Sequence
  Computer-generated peptide variant
LLRFMKKLYKRLKKLRNILKASSLDKLLPLEH

SEQ ID NO: 532 - protein, 42 aa, Artificial Sequence
  Computer-generated peptide variant
KYRLLKKILRKFQPARNKFRKLGCLRQASRYELALAMYTRIW

SEQ ID NO: 533 - protein, 58 aa, Artificial Sequence
  Computer-generated peptide variant
RLKFLRKMIRRIPRAALKYMCAEWGKKLAGAITLAGLKKYHIALFHADKKAPKLYCNL

SEQ ID NO: 534 - protein, 20 aa, Artificial Sequence
  Computer-generated peptide variant
RFRMWNKILKLWRKWALAAE

SEQ ID NO: 535 - protein, 37 aa, Artificial Sequence
  Computer-generated peptide variant
LLRMWKKYMRKWKCLACHAFIHLSTLLLRLMARVRAT

SEQ ID NO: 536 - protein, 21 aa, Artificial Sequence
  Computer-generated peptide variant
KFKYLPKMWRFMSKALKLLNL

SEQ ID NO: 537 - protein, 21 aa, Artificial Sequence
  Computer-generated peptide variant
RMRWWNRLFRKFKPIAAALLS

SEQ ID NO: 538 - protein, 21 aa, Artificial Sequence
  Computer-generated peptide variant
LFRLFTRWLRWLPRVLKQRGK

SEQ ID NO: 539 - protein, 26 aa, Artificial Sequence
  Computer-generated peptide variant
KLRLLSKLFKRLCRPLLKQALYDKAK

SEQ ID NO: 540 - protein, 34 aa, Artificial Sequence
  Computer-generated peptide variant
MLRLLKKFLKKWPSASLLRYCFLYFFAAKFRARR

SEQ ID NO: 541 - protein, 45 aa, Artificial Sequence
  Computer-generated peptide variant
YLRLWRKWLRKWKKDRGMLKWAEQGAAIGCLYLKEDAKLWPLKLF

SEQ ID NO: 542 - protein, 78 aa, Artificial Sequence
  Computer-generated peptide variant
KLRWLTKLWRRFNRLKQALQRFNLLLQYWRRTAKVAKLGKWREDAIYLQKIALSKNKAARTAKCSHAGWSKKKWIAIS

SEQ ID NO: 543 - protein, 70 aa, Artificial Sequence
  Computer-generated peptide variant
KWKIICRWMRRFRRAAAKTKRWAAKKNAGPAKYKRHEVYRLKKWEALHKVDFKCLWWRRSLAASTTRATL

SEQ ID NO: 544 - protein, 32 aa, Artificial Sequence
  Computer-generated peptide variant
FLRFLHRLLRKLHRKTKALRRELKAGAHKLFS

SEQ ID NO: 545 - protein, 40 aa, Artificial Sequence
  Computer-generated peptide variant
LLRMLPKYLKLFRSRHRFKCIALRRDKGDYMDVLRRHLYK

SEQ ID NO: 546 - protein, 66 aa, Artificial Sequence
  Computer-generated peptide variant
LLRMLQKFFRRLTQTKLRPSARLRGKARLRQLLMRMEKRRVLGGLYLFKVPLLNMAILNKCGRKQP

SEQ ID NO: 547 - protein, 20 aa, Artificial Sequence
  Computer-generated peptide variant
RIKYWHRFLKFLSPLLARGR

SEQ ID NO: 548 - protein, 76 aa, Artificial Sequence
  Computer-generated peptide variant
WYRLMTKLLRLLKQLFIKNKKNLFAFRLPMSRMLKTICWDGAMKKLLAMKMKGCATKVRKARFTWLNDKALLTLKK

SEQ ID NO: 549 - protein, 77 aa, Artificial Sequence
  Computer-generated peptide variant
KLKLIKKLLRRMRNRLRANCRVISALCTDWLCKWAKSEICDLCTLWLKRHKAKAKRANAKALLSAKLCKTAANMAAC

SEQ ID NO: 550 - protein, 43 aa, Artificial Sequence
  Computer-generated peptide variant
IFRMLCKFMRKLSRAALKMLTRGVCLAIPVLKIKYKQKKNLAA

SEQ ID NO: 551 - protein, 28 aa, Artificial Sequence
  Computer-generated peptide variant
LFRLLCRLLKRLRQGAPSKRPDADILKY

SEQ ID NO: 552 - protein, 24 aa, Artificial Sequence
  Computer-generated peptide variant
FLRMMTKFWKFLRTKAAQLRRGAR

SEQ ID NO: 553 - protein, 24 aa, Artificial Sequence
  Computer-generated peptide variant
YLRLFSKFFKRLKRAAFHFAQKLR

SEQ ID NO: 554 - protein, 38 aa, Artificial Sequence
  Computer-generated peptide variant
LWKLWRRLMRLLKSNRGYPVKLLEALGARKLSKVAEFD

SEQ ID NO: 555 - protein, 34 aa, Artificial Sequence
  Computer-generated peptide variant
RFRLMKRFFKILKKHYKLVHFARDAAQTAQYKAR

SEQ ID NO: 556 - protein, 24 aa, Artificial Sequence
  Computer-generated peptide variant
FYKLYRRLLRKWRTYAKLLVRHNL

SEQ ID NO: 557 - protein, 27 aa, Artificial Sequence
  Computer-generated peptide variant
LYRLMTRMLRKFQKRAGWDGMLTARRL

SEQ ID NO: 558 - protein, 47 aa, Artificial Sequence
  Computer-generated peptide variant
KLRMLRKFLRMLKRRAVGWKIPARQLLRFPIFAGRLYLYLSKCTARP

SEQ ID NO: 559 - protein, 60 aa, Artificial Sequence
  Computer-generated peptide variant
RYKILKKILRRIRHVRMLYAELDFLAHQLAGMWNIKLHWRARANYAPGRAKKLFGLRLLA

SEQ ID NO: 560 - protein, 30 aa, Artificial Sequence
  Computer-generated peptide variant
IMRIYKKLWKFLKRLPALRRNQLYYLLTAR

SEQ ID NO: 561 - protein, 21 aa, Artificial Sequence
  Computer-generated peptide variant
RMRLMCRYYRLLHRRNAAKDD

SEQ ID NO: 562 - protein, 50 aa, Artificial Sequence
  Computer-generated peptide variant
RFKLFQKWWKMFPCAARYKARKAAMRHLIRLILAERKAAVLHAMVDKKLQ

SEQ ID NO: 563 - protein, 75 aa, Artificial Sequence
  Computer-generated peptide variant
KLKMLQKMLKKMTKGCLLVAYNLLKRATVVATAKLRLYKKLRIAFNGKKKCLKLKVKMNMSCKAFRNKAKKKYAD

SEQ ID NO: 564 - protein, 64 aa, Artificial Sequence
  Computer-generated peptide variant
LFRLLPRYMRLLKPAMDKKALQAAWGRLEEHEQLLKGKYLRRIKLTLKNCKAWTKWFRLACPKC

SEQ ID NO: 565 - protein, 36 aa, Artificial Sequence
  Computer-generated peptide variant
YIRMIRKILRLFQQLRLYQLRMRRAKKHAHLLAEHW

SEQ ID NO: 566 - protein, 55 aa, Artificial Sequence
  Computer-generated peptide variant
IMKLWRKFLKYYRCQPHKVLFRRRYLRLWSATLRRQRKLRMTARKAAITLRWLHA

SEQ ID NO: 567 - protein, 76 aa, Artificial Sequence
  Computer-generated peptide variant
RLRMLRRFMKRIKKRHSLLKLECRLAAAKSAWKLLCKELDSAIVAMVRKFPTARLKAYTKKRFDGQKLRHVRVNLL

SEQ ID NO: 568 - protein, 28 aa, Artificial Sequence
  Computer-generated peptide variant
RMRLWKRMFKLLPKRLLGAGDKAGSAPR

SEQ ID NO: 569 - protein, 28 aa, Artificial Sequence
  Computer-generated peptide variant
LYKLLQRLFKLYQRRKRDLAGKLRLIWK

SEQ ID NO: 570 - protein, 21 aa, Artificial Sequence
  Computer-generated peptide variant
KLRFLCRLMKFYKRAAKAMSL

SEQ ID NO: 571 - protein, 61 aa, Artificial Sequence
  Computer-generated peptide variant
RLKYFKRIWKRLKRPYWGEKSPAAHLQYLNAGKRLKGREATACVALLTRKQYAVLAAVRCR

SEQ ID NO: 572 - protein, 33 aa, Artificial Sequence
  Computer-generated peptide variant
IMKWLKRWYKYFRRKALAKMTARSLACYRADTK

SEQ ID NO: 573 - protein, 55 aa, Artificial Sequence
  Computer-generated peptide variant
IIRLYHKMIRYLRCVKFRSLVTKRPLLNGAAKLQRFHTTKVARHKLAKKLKKRWL

SEQ ID NO: 574 - protein, 87 aa, Artificial Sequence
  Computer-generated peptide variant
KYKFFRRLLRKMHKVKRMLQPMWLWLQRKAYGRLLGARGCRAVRCRMRLHDKRSHCKAYPLAGRKATRLRTHNKLSHHERRLGTALR

SEQ ID NO: 575 - protein, 24 aa, Artificial Sequence
  Computer-generated peptide variant
FLKFLTKYFRKFSKKAPIRARLEL

SEQ ID NO: 576 - protein, 43 aa, Artificial Sequence
  Computer-generated peptide variant
RLKMLPRLFRKYNKLHRKSNVIHKAMDRLHLKVRTLAKPKLLR

SEQ ID NO: 577 - protein, 30 aa, Artificial Sequence
  Computer-generated peptide variant
FFRWMSRLLRRIKRDAYMKLTPSLLLKLRY

SEQ ID NO: 578 - protein, 35 aa, Artificial Sequence
  Computer-generated peptide variant
RLKFLHRWLRRYNCWLTITALARRPRLKQARVWAH

SEQ ID NO: 579 - protein, 31 aa, Artificial Sequence
  Computer-generated peptide variant
LFKLICRLLKRYSRMRYRLCRCRKYCMLAIA

SEQ ID NO: 580 - protein, 37 aa, Artificial Sequence
  Computer-generated peptide variant
YMRFFTRLWRWFSRLGAKSARAYARLRLMRMILRRFR

SEQ ID NO: 581 - protein, 58 aa, Artificial Sequence
  Computer-generated peptide variant
RLRFYRRLMRKLQRDLRRRKLSKSAFFQLRISEKLAYFVFKTLRLARYSVRLPQPLLA

SEQ ID NO: 582 - protein, 22 aa, Artificial Sequence
  Computer-generated peptide variant
LYKIIRKLLRRLPRAIMDMLKA

SEQ ID NO: 583 - protein, 71 aa, Artificial Sequence
  Computer-generated peptide variant
RLRIYRRIWRKIKTLLVKLRESDAKLAKKARANAFRADYELMRRNTVKGSKLALRNRKVVRLFRLGWALET

SEQ ID NO: 584 - protein, 83 aa, Artificial Sequence
  Computer-generated peptide variant
KFRLLHKLYKRLNKERKKRHIRGETLMLYNKTALPRRCLLRFAFGRRNRAAPTRQQVRKHYGKAAAHKLKLLRSEIAAIKLAP

SEQ ID NO: 585 - protein, 44 aa, Artificial Sequence
  Computer-generated peptide variant
KLKLYRKWLRLFTQLRKLGKFLPRHDAWARRVMGANQLWYMLLA

SEQ ID NO: 586 - protein, 45 aa, Artificial Sequence
  Computer-generated peptide variant
KLRLIKRYMRKWKHLLKCQLNRMCLFRLERKAQKRVILLVHMELW

SEQ ID NO: 587 - protein, 84 aa, Artificial Sequence
  Computer-generated peptide variant
RLKLYPRFWKMMPKLPRLKAVARMLKKKKRLWLLSQYLGLPEPKMRGMHEDKAAIADKVLYRLLKDSLLYAVLLLPLIHLANKK

SEQ ID NO: 588 - protein, 24 aa, Artificial Sequence
  Computer-generated peptide variant
KYRWFKKMFRLFTRAMLLEALYLR

SEQ ID NO: 589 - protein, 20 aa, Artificial Sequence
  Computer-generated peptide variant
RMKLWHRLYKRWQTIKLLAL

SEQ ID NO: 590 - protein, 49 aa, Artificial Sequence
  Computer-generated peptide variant
MLRLFKRLLRFFTRLLERLFQLRKKSRATDKKKRAPEFALCLYELHYRY

SEQ ID NO: 591 - protein, 49 aa, Artificial Sequence
  Computer-generated peptide variant
FWKYMNRLLRLMTRNLASLNSAEAPKPLCKLINARRIKEALARLKWKQW

SEQ ID NO: 592 - protein, 46 aa, Artificial Sequence
  Computer-generated peptide variant
LLKLMRKFLKLLSNKPIRLLKLVSRRDIWMVKLRLANGQAWLYKIW

SEQ ID NO: 593 - protein, 29 aa, Artificial Sequence
  Computer-generated peptide variant
WLKILTKYMKILRRDAKVDLLLKKKRLYL

SEQ ID NO: 594 - protein, 27 aa, Artificial Sequence
  Computer-generated peptide variant
YFKILRKLIKWLRRGLDLKLKAVLYRP

SEQ ID NO: 595 - protein, 42 aa, Artificial Sequence
  Computer-generated peptide variant
YLRLFRRYYKFMKSYREARLKIALIRRQMCLAATAYLAKTDR

SEQ ID NO: 596 - protein, 49 aa, Artificial Sequence
  Computer-generated peptide variant
RFRYLNKLWRKWTHRNRKANLRWRFDQALRLILPQADMKAKLDAARVRD

SEQ ID NO: 597 - protein, 44 aa, Artificial Sequence
  Computer-generated peptide variant
KLRFLRKLFRKLSRYVWNCRAIVPAWYTKKELEKLKLANLLTRY

SEQ ID NO: 598 - protein, 99 aa, Artificial Sequence
  Computer-generated peptide variant
RYRLLKRMIRKFRCAMRARKKAQLLKQVKNLKYQPIRADEFDRILMDFAPLRLTLRRRMINRDKALTRWLACGLYRVNAHMARVVWARLEAKQREGLRL

SEQ ID NO: 599 - protein, 61 aa, Artificial Sequence
  Computer-generated peptide variant
YLRILRRLMRKLSRRACHYKELACILARCTLWLRWSVVRLAAKLIRFKKNRWDCLRILRLL

SEQ ID NO: 600 - protein, 27 aa, Artificial Sequence
  Computer-generated peptide variant
KLKLYKRWWRYFSKAWFHRKLNACNLA

SEQ ID NO: 601 - protein, 30 aa, Artificial Sequence
  Computer-generated peptide variant
KMRMLTRLFKRMRRSLRARMLDDALIAADL

SEQ ID NO: 602 - protein, 22 aa, Artificial Sequence
  Computer-generated peptide variant
LLRIFCRMYRRFSRKYLLLRCA

SEQ ID NO: 603 - protein, 20 aa, Artificial Sequence
  Computer-generated peptide variant
LIRMYRKFLRRLHNALYKIM

SEQ ID NO: 604 - protein, 33 aa, Artificial Sequence
  Computer-generated peptide variant
WLRLMRKLLRKLKCKQWLQKHASVRLALLAIVG

SEQ ID NO: 605 - protein, 20 aa, Artificial Sequence
  Computer-generated peptide variant
YLRMLRKLLKRMHQAAFNLS

SEQ ID NO: 606 - protein, 60 aa, Artificial Sequence
  Computer-generated peptide variant
LLRLFQRLWRKLRNGKAKLGHLWKLDGKAQLYAVHMAEKTLRYHTRYPCFKAARRARRGY

SEQ ID NO: 607 - protein, 25 aa, Artificial Sequence
  Computer-generated peptide variant
RMRFYSRYLKFLKNLALMLNAKKKD

SEQ ID NO: 608 - protein, 29 aa, Artificial Sequence
  Computer-generated peptide variant
FLKLWCKLLRKLQQGKPYLRRRAAATCRQ

SEQ ID NO: 609 - protein, 100 aa, Artificial Sequence
  Computer-generated peptide variant
LFRMITKYMKRLRRKVCMAGYRAKLNKNPKLERLLSAYAKQPVRMARGALAMRLEFDVEAYFLILKQLQYHAYRIAIARTKSEWRAAKKKSKRLRKDYAK

SEQ ID NO: 610 - protein, 30 aa, Artificial Sequence
  Computer-generated peptide variant
RYKIWPRLLKILRRAWQRELKIFLPGNRLR

SEQ ID NO: 611 - protein, 65 aa, Artificial Sequence
  Computer-generated peptide variant
KLKILRKWYRKLQHKAHNARHQRAYPELARATTSALCDKRRKRCSKRKIPARLLALNREHRQRES

SEQ ID NO: 612 - protein, 23 aa, Artificial Sequence
  Computer-generated peptide variant
YLKYIKKLLKKLNSRLARAIRSL

SEQ ID NO: 613 - protein, 67 aa, Artificial Sequence
  Computer-generated peptide variant
WYKLLRRYIRRFKTKEQLANKRCAKLDALRCRTRPEKRNKSEFLLDAIPHLALKVARRSPFRAMRQG

SEQ ID NO: 614 - protein, 36 aa, Artificial Sequence
  Computer-generated peptide variant
RIRFLSRLLKKFRKDSTMYAQDARARLGALQKYRWS

SEQ ID NO: 615 - protein, 55 aa, Artificial Sequence
  Computer-generated peptide variant
WLRLLRKLFRRMKKKEIARITKSLKRIQANFNTRAGAKIQRTQAATALCNNRILK

SEQ ID NO: 616 - protein, 48 aa, Artificial Sequence
  Computer-generated peptide variant
FFRFWSRFFKKWKKLLLAALKASFVQRKCANAKMTRRCALARQKLKWD

SEQ ID NO: 617 - protein, 54 aa, Artificial Sequence
  Computer-generated peptide variant
WLKWIKRFLRMLCTKIKKASAKAARKLAAVNWRKGDRLSSKKYAKQRNALAMRQ

SEQ ID NO: 618 - protein, 45 aa, Artificial Sequence
  Computer-generated peptide variant
KIRMFKRILRYFHRAALVRHYAVDRVTKGCLLLLRALPKIWWKRA

SEQ ID NO: 619 - protein, 24 aa, Artificial Sequence
  Computer-generated peptide variant
MLKLMRKMLRLLCHRVAKRDHIRY

SEQ ID NO: 620 - protein, 51 aa, Artificial Sequence
  Computer-generated peptide variant
FIKFLRRWLKFMNNLCYYAMRKLLVKAFRKRLKILHRYIRNRRWLLLKLKT

SEQ ID NO: 621 - protein, 23 aa, Artificial Sequence
  Computer-generated peptide variant
ILRFLCKILKRLKQNFLATLKCP

SEQ ID NO: 622 - protein, 26 aa, Artificial Sequence
  Computer-generated peptide variant
MLKMFRRLWKRLNKFLARQKLLRWNY

SEQ ID NO: 623 - protein, 36 aa, Artificial Sequence
  Computer-generated peptide variant
RLKFLRRLWKWLKCAPRRALPRAAKLTRCLENSLMK

SEQ ID NO: 624 - protein, 66 aa, Artificial Sequence
  Computer-generated peptide variant
LFRMLPRMWRMFKQKDIFSDALKKKALKKLFQWEQRHALLRKSFLKALRRVFIHTRLRCRKASRAQ

SEQ ID NO: 625 - protein, 22 aa, Artificial Sequence
  Computer-generated peptide variant
KWRFLCRYIKLMNKALLWAERL

SEQ ID NO: 626 - protein, 40 aa, Artificial Sequence
  Computer-generated peptide variant
KFRFLRKMYRRLKKKIPYCQLQRNTMRQAAAVCAARLLKR

SEQ ID NO: 627 - protein, 63 aa, Artificial Sequence
  Computer-generated peptide variant
RIKMLTKFIRMLSRLRAVRKFRLECCLQAQDWLFKDSTRAQIEMLAHKRARKKVRAAATARLP

SEQ ID NO: 628 - protein, 79 aa, Artificial Sequence
  Computer-generated peptide variant
RYRLIKKWLKKFRPRLRAASRAKALKMGKLCAKRPAGQDLPRLWAMNHENRGYYNAGAYRAGKAFKRKAYKNKILARLR

SEQ ID NO: 629 - protein, 82 aa, Artificial Sequence
  Computer-generated peptide variant
KLKLLQKIFKKFQRELGLRNKLALKAELNTSRRLLCFYTLLKKRIILKKKWGAQAWRLYDHRTMLRTRKLAVKKAADMLIAF

SEQ ID NO: 630 - protein, 23 aa, Artificial Sequence
  Computer-generated peptide variant
KLKMFPRFLRKLSKAKAVDQACT

SEQ ID NO: 631 - protein, 26 aa, Artificial Sequence
  Computer-generated peptide variant
RLKWIKRLFRRMRQAMIRNALCAARM

SEQ ID NO: 632 - protein, 43 aa, Artificial Sequence
  Computer-generated peptide variant
FWRLLQRLLKRLTPALLPCSKRLVVHRGLTAKRRAADKHAPKC

SEQ ID NO: 633 - protein, 51 aa, Artificial Sequence
  Computer-generated peptide variant
KLRIFKRMLKFIKKAAAAYCLAKAERSGRKKCLDGVAVPKPQGKANKPYKR

SEQ ID NO: 634 - protein, 32 aa, Artificial Sequence
  Computer-generated peptide variant
LLRILPRFFRIFRNARWHQLRDLKLLLVEKAR

SEQ ID NO: 635 - protein, 36 aa, Artificial Sequence
  Computer-generated peptide variant
FFRILTRLLRFWNREGARRAKTTALRSALDWRKGQR

SEQ ID NO: 636 - protein, 43 aa, Artificial Sequence
  Computer-generated peptide variant
LYRLMKRLLRKMKCLNAKGMKFKGKCAIRALQKCAHRRARLHF

SEQ ID NO: 637 - protein, 50 aa, Artificial Sequence
  Computer-generated peptide variant
LYKFYRRFWKRYQKRKYKADAHFAKRVALVALAPMKGKETLRSRAATGKC

SEQ ID NO: 638 - protein, 36 aa, Artificial Sequence
  Computer-generated peptide variant
KLRLFKKMLKKFKCKAMLSANDMARQSVAKWLASAT

SEQ ID NO: 639 - protein, 39 aa, Artificial Sequence
  Computer-generated peptide variant
RYKLFRKFYRKYPQNLAAARARVPRVRADCQLRKARTAL

SEQ ID NO: 640 - protein, 39 aa, Artificial Sequence
  Computer-generated peptide variant
KMKIYKKLIKRLKKQKAAAQHIPRGLLLYLCKRLAGRRW

SEQ ID NO: 641 - protein, 25 aa, Artificial Sequence
  Computer-generated peptide variant
FWRLFHKLFRKITRDLKLNAWARKN

SEQ ID NO: 642 - protein, 38 aa, Artificial Sequence
  Computer-generated peptide variant
WLKWLCKFYKYYKCCRPRRRVLALKRLKMLRSLPQLQH

SEQ ID NO: 643 - protein, 27 aa, Artificial Sequence
  Computer-generated peptide variant
RFKYLKRFLRLLRRGVVAGLKQILSIH

SEQ ID NO: 644 - protein, 49 aa, Artificial Sequence
  Computer-generated peptide variant
LLRFFRKLLKRLSKGRTCNFFFPICNQLKNKKANRMAAAKALRRYRILF

SEQ ID NO: 645 - protein, 28 aa, Artificial Sequence
  Computer-generated peptide variant
KMRFIKKWLRLICRSILRFRALLGGQRL

SEQ ID NO: 646 - protein, 72 aa, Artificial Sequence
  Computer-generated peptide variant
MWRFFRKWYKKFKNPARRIKLALRSADVLQQLAFYDQRRKELTKDTLSRRVSRLAAARHLVRRLWQEEAKLL

SEQ ID NO: 647 - protein, 59 aa, Artificial Sequence
  Computer-generated peptide variant
KLKFFTKILKKFPKRALLYTRTALKAHKERSYLRRVYKTDCLLRVKAKWNRLQNVYALC

SEQ ID NO: 648 - protein, 28 aa, Artificial Sequence
  Computer-generated peptide variant
RLKLLRKLLKMIKKWADHKAPKEHMRCL

SEQ ID NO: 649 - protein, 26 aa, Artificial Sequence
  Computer-generated peptide variant
KLKFLNKFLRRWKPLIANPLADKRMP

SEQ ID NO: 650 - protein, 72 aa, Artificial Sequence
  Computer-generated peptide variant
YLKLFRKLIRKFKTRLVVFESNKLMAARYLRKKPVLLALHRLFLLRRDARHRELSPKRQLHIHRLQFPLMAR

SEQ ID NO: 651 - protein, 38 aa, Artificial Sequence
  Computer-generated peptide variant
RMRMLPKLLRLLTKANKNKFYMMLKLARCFANRLGYAH

SEQ ID NO: 652 - protein, 40 aa, Artificial Sequence
  Computer-generated peptide variant
WWKLWNKFYKRFKCRPALQDRCRKAFRKKVKLVAYLQLLA

SEQ ID NO: 653 - protein, 41 aa, Artificial Sequence
  Computer-generated peptide variant
RLKFYTKFMRRWNRAIVERNAAPLTAAKDALQLALKLPHKG

SEQ ID NO: 654 - protein, 89 aa, Artificial Sequence
  Computer-generated peptide variant
FLKIIKRFIRFMKTDLKRLKRSKYTVAKYIWVWVEEDARARKLAAHKHAALLSLRCARDARKYCKCYSGHKAKIEKKLDARAKLARRHD

SEQ ID NO: 655 - protein, 40 aa, Artificial Sequence
  Computer-generated peptide variant
RIKFLCKLMKKLRKWQKKVGLAKLPAKLLSQVNDLKLMQP

SEQ ID NO: 656 - protein, 40 aa, Artificial Sequence
  Computer-generated peptide variant
KLKFFRKWMKLICKGALAKLPDKAHKRQGIKYASALRCRG

SEQ ID NO: 657 - protein, 55 aa, Artificial Sequence
  Computer-generated peptide variant
RLRWIRRWFKLMTKCAKNWARAEKREYADAAYRAYLNRPARALAARPRKLTKARG

SEQ ID NO: 658 - protein, 58 aa, Artificial Sequence
  Computer-generated peptide variant
RFKLLTKLIRKLRNPALAKVCRMRMHVDGWERWLEPHARKARVRTRLHALHKLGASLV

SEQ ID NO: 659 - protein, 22 aa, Artificial Sequence
  Computer-generated peptide variant
FLRFLTRLFKRWKRKLAHSTAA

SEQ ID NO: 660 - protein, 67 aa, Artificial Sequence
  Computer-generated peptide variant
KIRLYKKFWRKLSRRHMTSNAAKMADNRRKRAGIAARRKRAASMAAAMRPRQTTQASVRRARLGRLF

SEQ ID NO: 661 - protein, 34 aa, Artificial Sequence
  Computer-generated peptide variant
LFKFFNRLLKRIRRMPAVILLAEAKTPHCKRAFK

SEQ ID NO: 662 - protein, 74 aa, Artificial Sequence
  Computer-generated peptide variant
KLRFFCKIFRKIRRHLLAKLAVIQRWQLPAIRAKAWRLVHATATARTRADRDRIRLKKLYARARGRQRFRALCR

SEQ ID NO: 663 - protein, 25 aa, Artificial Sequence
  Computer-generated peptide variant
FLKMLHKLFKRICKIREAAMARRHS

SEQ ID NO: 664 - protein, 29 aa, Artificial Sequence
  Computer-generated peptide variant
LIRMLRKFLRRWRTRHLAAAALTIKKFLA

SEQ ID NO: 665 - protein, 70 aa, Artificial Sequence
  Computer-generated peptide variant
MMRLFRRLYKKMCNHWRLSHLRLKTYNRQAIAGAAKAPAGLQKALVLRFLARLRTLELMFYPKVKLLVDA

SEQ ID NO: 666 - protein, 36 aa, Artificial Sequence
  Computer-generated peptide variant
IWRFYKKLMRLLKKKALACSRRLSADLEFRNKHDLV

SEQ ID NO: 667 - protein, 36 aa, Artificial Sequence
  Computer-generated peptide variant
RMRLLSRWLRRFNKRHLWLLAKLELKLLSKWRKSIA

SEQ ID NO: 668 - protein, 25 aa, Artificial Sequence
  Computer-generated peptide variant
MLRFFCRFLKRLHCSAKLLAHIKNR

SEQ ID NO: 669 - protein, 39 aa, Artificial Sequence
  Computer-generated peptide variant
RLKLMRKFWRKLKTLLLHKQKRIKRCERPAGAKAALTAP

SEQ ID NO: 670 - protein, 22 aa, Artificial Sequence
  Computer-generated peptide variant
FMRFIKKLLKKYRNALSALQLY

SEQ ID NO: 671 - protein, 20 aa, Artificial Sequence
  Computer-generated peptide variant
YFKLYKRLLRLFKQGNLYDA

SEQ ID NO: 672 - protein, 30 aa, Artificial Sequence
  Computer-generated peptide variant
RWKYYPRLWKKIQKLRQYQGAAKKLRLNAA

SEQ ID NO: 673 - protein, 61 aa, Artificial Sequence
  Computer-generated peptide variant
LMKYLSRLFKKLNRARKALAKAARPRAMLKRRLGGTCGICKALQTTKSIVFCIGLRWLYLM

SEQ ID NO: 674 - protein, 24 aa, Artificial Sequence
  Computer-generated peptide variant
MIRLMRRLLRYFKSSALNRKGLLL

SEQ ID NO: 675 - protein, 73 aa, Artificial Sequence
  Computer-generated peptide variant
KLRMFKRLFRLFKKLAHFHVLMLYCKFRKRQINALKLDYKKRRKVALIAMKRDMLKFKRRYRHLLWKWMALWT

SEQ ID NO: 676 - protein, 40 aa, Artificial Sequence
  Computer-generated peptide variant
KLKMMRKLLKKLRPKVDIARAQYLWMRLALSDYLYYIAAA

SEQ ID NO: 677 - protein, 25 aa, Artificial Sequence
  Computer-generated peptide variant
LYKLMTRIMKRWHRADELKHAILLR

SEQ ID NO: 678 - protein, 23 aa, Artificial Sequence
  Computer-generated peptide variant
KMRYITKIMKLYNRDAKLALAHL

SEQ ID NO: 679 - protein, 21 aa, Artificial Sequence
  Computer-generated peptide variant
RFRLLRRWYKLLKHPRISYLQ

SEQ ID NO: 680 - protein, 40 aa, Artificial Sequence
  Computer-generated peptide variant
RLKLFKKWLRKLTQRDNRRLKLLDGSAKCHNYLNHPNDRA

SEQ ID NO: 681 - protein, 46 aa, Artificial Sequence
  Computer-generated peptide variant
YWRLLPRMLKLFKTLKLRLAYLRKLASGRKLTVAREKKQPGRQYKP

SEQ ID NO: 682 - protein, 35 aa, Artificial Sequence
  Computer-generated peptide variant
LLRLIQRLIRLFNRKINLARMRRRVHNVKLLYLAT

SEQ ID NO: 683 - protein, 57 aa, Artificial Sequence
  Computer-generated peptide variant
KWKFYRKLFKLLRKHAETKDIADARKLNAKCKWLVAVHCLALCARAKNRWAYIYRNR

SEQ ID NO: 684 - protein, 24 aa, Artificial Sequence
  Computer-generated peptide variant
KLRFLRRILRYLTRRMHKCTGANL

SEQ ID NO: 685 - protein, 71 aa, Artificial Sequence
  Computer-generated peptide variant
KFKIFTKIYKKLKRLLLGGHKPRKKVDLLFKCTNVKKLHRAPLCRAQILPLVANAFLARARKRQLFLGRKD

SEQ ID NO: 686 - protein, 33 aa, Artificial Sequence
  Computer-generated peptide variant
LFKILCKLLKWLRRSRRMSAVDDRMAFQLRNAL

SEQ ID NO: 687 - protein, 30 aa, Artificial Sequence
  Computer-generated peptide variant
WFRFLCKILRRLRKAKLAAYHNARARWAMQ

SEQ ID NO: 688 - protein, 34 aa, Artificial Sequence
  Computer-generated peptide variant
WLRMLKRFYKLFQSKLHKKTMQDPLAKKKRLELG

SEQ ID NO: 689 - protein, 37 aa, Artificial Sequence
  Computer-generated peptide variant
LLKWLKKLFRILKKDCPKANLQGACRALHFKCLNYLQ

SEQ ID NO: 690 - protein, 83 aa, Artificial Sequence
  Computer-generated peptide variant
RMKYLPRLFRWFKKRHLPRSLCALSADGLARAVKDLRQVQKNRALHARMMANKLPLCLAFLAEARNLESTRIAKRAQRMLRAK

SEQ ID NO: 691 - protein, 74 aa, Artificial Sequence
  Computer-generated peptide variant
ILRFYRRLLRLMHRKAHKRRLRLFAVHTMCRAAKGIRDSKAKVKLYLQLPYARASIRALEETWKKFALALAAEL

SEQ ID NO: 692 - protein, 45 aa, Artificial Sequence
  Computer-generated peptide variant
YMKMIRKLLKKYSKLFHHLKFEANIAKVKLYQKHRAQLPLAKRLE

SEQ ID NO: 693 - protein, 89 aa, Artificial Sequence
  Computer-generated peptide variant
FLRWYRKYLKKIKRHYKRMVRKECVENMLKRAAKACEYTVKNALKKWHAAYKALDASGGDRNHTAFLRARPAADSRKKRVRAFELALTK

SEQ ID NO: 694 - protein, 34 aa, Artificial Sequence
  Computer-generated peptide variant
KIKLFRKLLKLLCKMGIKMLKHEARKAGWIHAYL

SEQ ID NO: 695 - protein, 36 aa, Artificial Sequence
  Computer-generated peptide variant
KLKFFQKLLRRLKPARRKMLVLLSRLARGELELKID

SEQ ID NO: 696 - protein, 35 aa, Artificial Sequence
  Computer-generated peptide variant
FFKYMRKLFKKLRKNDRLLCMIRLAPHALALLRYL

SEQ ID NO: 697 - protein, 98 aa, Artificial Sequence
  Computer-generated peptide variant
KIRMLSKMFRRLRKYPTTNLQNTRRAGQPNHAHELAKHLLRLVDSFYKHHHRQLRLALRRLERRLRPMRLTKGAQAALLLRFAWPGKLLLRCRRKRTL

SEQ ID NO: 698 - protein, 23 aa, Artificial Sequence
  Computer-generated peptide variant
LWKLFNKFIKRLRTLVADLKKTR

SEQ ID NO: 699 - protein, 60 aa, Artificial Sequence
  Computer-generated peptide variant
RFKLLCRFLKRMRQHCAKRVRAKRLIKIANLDLKHKAECTLRPWFKKIAGYAHKRNGQAE

SEQ ID NO: 700 - protein, 74 aa, Artificial Sequence
  Computer-generated peptide variant
FLRYLRKFMKKFRRDYAARLARCMRECRLAKAKLILRAKRCFVAFILDKRRYRGRAETHKWKFTKGYALPPIRA

SEQ ID NO: 701 - protein, 20 aa, Artificial Sequence
  Computer-generated peptide variant
LLKLLRKWFKFFCQLNTGRK

SEQ ID NO: 702 - protein, 34 aa, Artificial Sequence
  Computer-generated peptide variant
KIKILQRLLRKMTCFRKARAYSPRVLEAAGSLNK

SEQ ID NO: 703 - protein, 45 aa, Artificial Sequence
  Computer-generated peptide variant
KFRLLHKMLKRLCQTEKRGPSRLLAYRRAFGRAPKKPPNKADRPL

SEQ ID NO: 704 - protein, 21 aa, Artificial Sequence
  Computer-generated peptide variant
KWRLLNRWLKRFKNAAHLTYA

SEQ ID NO: 705 - protein, 79 aa, Artificial Sequence
  Computer-generated peptide variant
YFKFYKRFLKRLPKARRTCYVIKEQRRGAYKPLKPLALLWCMQRLVYRRAKFKRAQAGPSKKGLKKKIVLKDLKLLHAG

SEQ ID NO: 706 - protein, 54 aa, Artificial Sequence
  Computer-generated peptide variant
LLRMLKKFLRMLTTCHKAAKWEPARNTLLLEYVKTLRKDKLRARKKWLLKHEHA

SEQ ID NO: 707 - protein, 39 aa, Artificial Sequence
  Computer-generated peptide variant
YLKLWRKWLKLLKKHDWLQRRRQYCGRRSTAAYKTAFLM

SEQ ID NO: 708 - protein, 59 aa, Artificial Sequence
  Computer-generated peptide variant
MLKFLTRWLRRFKKKRMLDWLNKLAKWTIIELYRAAKDHDPKRALYEAAKLLLAVCLVW

SEQ ID NO: 709 - protein, 80 aa, Artificial Sequence
  Computer-generated peptide variant
KMRYFRRWLRRLRPPDGRYADKLPRQRWKFMFKRLELQSRKLRRKSAPLKLAKELKASAMACFLDFKKCLQYKRLSVWPS

SEQ ID NO: 710 - protein, 25 aa, Artificial Sequence
  Computer-generated peptide variant
ILRWFKRFLKYIKRCAKTRAGAAKA

SEQ ID NO: 711 - protein, 45 aa, Artificial Sequence
  Computer-generated peptide variant
FLRLWCRLLRKLRRLHCKQATKAALHAGSRGFHVKRILADLFKYG

SEQ ID NO: 712 - protein, 42 aa, Artificial Sequence
  Computer-generated peptide variant
RWKLLKKILRFMCKAHATIIRKKPLTKLGHGLLALALRKGWL

SEQ ID NO: 713 - protein, 33 aa, Artificial Sequence
  Computer-generated peptide variant
KLRIYKKLFRRMHQTNRLRVGLRHKQRLCVALL

SEQ ID NO: 714 - protein, 37 aa, Artificial Sequence
  Computer-generated peptide variant
RFKLFKRLWRKLSKAGRDNLHAKRHALMQVTLLCARD

SEQ ID NO: 715 - protein, 23 aa, Artificial Sequence
  Computer-generated peptide variant
YFRLWNRIFKRWKNDKLRLLLAV

SEQ ID NO: 716 - protein, 39 aa, Artificial Sequence
  Computer-generated peptide variant
RFKYLKRYWKIYRRCTARRKTSLSAHRTLLAAKILLSKH

SEQ ID NO: 717 - protein, 29 aa, Artificial Sequence
  Computer-generated peptide variant
LFRLLQRWYRKIKKKLLGCEHNKLAGMNL

SEQ ID NO: 718 - protein, 44 aa, Artificial Sequence
  Computer-generated peptide variant
LLKLLRKILRRFRKICRLGGCKLLWKSPKLKLLDRPRYQLLFMK

SEQ ID NO: 719 - protein, 20 aa, Artificial Sequence
  Computer-generated peptide variant
KLRLFKKYMRRLHPKLANLS

SEQ ID NO: 720 - protein, 20 aa, Artificial Sequence
  Computer-generated peptide variant
KLRYWRKILKLMHKLFGAWK

SEQ ID NO: 721 - protein, 57 aa, Artificial Sequence
  Computer-generated peptide variant
FLRLLKKLMKRYHRARLRSKKARRFKQDFLRLKVARQALHWYACEKLRYGLIWCMTL

SEQ ID NO: 722 - protein, 36 aa, Artificial Sequence
  Computer-generated peptide variant
LYKLMKKLFKRLTQLAMMARAWLKLLKKEKRKKSYY

SEQ ID NO: 723 - protein, 64 aa, Artificial Sequence
  Computer-generated peptide variant
ILRLLTKLFRKYRQNRKAWLKLLQARCRIKMGVYKAKRAMRAYWIEQRRRKARERDWCSALDFT

SEQ ID NO: 724 - protein, 22 aa, Artificial Sequence
  Computer-generated peptide variant
RLKLIKRYFRRLRNYAVALREA

SEQ ID NO: 725 - protein, 80 aa, Artificial Sequence
  Computer-generated peptide variant
WWRLIRRILKKYKQAKKLRTWLLRLLKKKTQKDYEAKAYKRSRLRHFGILMFMLMALRAKKSYIHYCLQRRAAYVRPKLY

SEQ ID NO: 726 - protein, 38 aa, Artificial Sequence
  Computer-generated peptide variant
KFKLLCKLLKKWSRDLSKLMLRQEIMIFFIKKNRQLLL

SEQ ID NO: 727 - protein, 28 aa, Artificial Sequence
  Computer-generated peptide variant
FLRIFRKLLRKMNKREWRQWLPAQMAKA

SEQ ID NO: 728 - protein, 50 aa, Artificial Sequence
  Computer-generated peptide variant
KIRIIKRILKKLKSLRTPKYAKKRKVANLKWKCLTAKNAKAFLAFLRRLM

SEQ ID NO: 729 - protein, 44 aa, Artificial Sequence
  Computer-generated peptide variant
ILRLITRLIKRFHSVRKALRRLFFAATEWLFKFSWKLKARLVRE

SEQ ID NO: 730 - protein, 78 aa, Artificial Sequence
  Computer-generated peptide variant
KYKLMRRFLRKWCSHEGKDLKWRTAASTRKWRLKQEAALRKLKWLSLAFALARAHFKIIKRRMMQHHVLKCAAMQAKR

SEQ ID NO: 731 - protein, 89 aa, Artificial Sequence
  Computer-generated peptide variant
KWKILNRLIKKYHTWKCASRRAPRCQMKLKRKMGLPRDTRDRAIHRVAASAKKRRRPRAYACLAQHVYKLLKVALFNSKAVKAKYAQLD

SEQ ID NO: 732 - protein, 33 aa, Artificial Sequence
  Computer-generated peptide variant
KLKIYTRFWKRLHRLKRFLISSAVALRDRRAYV

SEQ ID NO: 733 - protein, 84 aa, Artificial Sequence
  Computer-generated peptide variant
FWKLYNRLFRFWKPLDEQKKMWLKPLELHKLKKLNMIGFLHRTLFLHWAAAKRARKRQMLVRGFLEFKLKARLKKKLLAAAILS

SEQ ID NO: 734 - protein, 37 aa, Artificial Sequence
  Computer-generated peptide variant
LLRIFRRIFKKLSRYINARARRRKQACTLPNQLMAAG

SEQ ID NO: 735 - protein, 39 aa, Artificial Sequence
  Computer-generated peptide variant
ILRLFKKYMKKIKKEALKLAGLRAVAKDQPHAKLMDFPR

SEQ ID NO: 736 - protein, 23 aa, Artificial Sequence
  Computer-generated peptide variant
KLRLLKRFWKRLHCSRASKQKLL

SEQ ID NO: 737 - protein, 24 aa, Artificial Sequence
  Computer-generated peptide variant
RLKLLTKFWKKFKKLASITDYALC

SEQ ID NO: 738 - protein, 20 aa, Artificial Sequence
  Computer-generated peptide variant
RMKILKRLLKFIPKHGDAQA

SEQ ID NO: 739 - protein, 72 aa, Artificial Sequence
  Computer-generated peptide variant
RLKLLPKLWKKMKSLFKCRWEFMAGFRCLLLKRTTNNPRARVIARRLTWIRAEYLFRKVMLVRASSAARARN

SEQ ID NO: 740 - protein, 27 aa, Artificial Sequence
  Computer-generated peptide variant
MLKWFQKFLKRLKKLQRRALEKALWRE

SEQ ID NO: 741 - protein, 56 aa, Artificial Sequence
  Computer-generated peptide variant
KLKFFRRFIKLMRCKKKVHVTEIHCAALHLPPKARNLKASLTKKRVRRIGAFKFLL

SEQ ID NO: 742 - protein, 28 aa, Artificial Sequence
  Computer-generated peptide variant
KFRLLKRFLRRFRNLAAFACLKQKPMCI

SEQ ID NO: 743 - protein, 76 aa, Artificial Sequence
  Computer-generated peptide variant
KFKLYKRMFKRLKPGRADKLAKHRGHLRYAYLSKLHLAKLRSCHCGLTRFQHIKKMLNALADKLLAYKRDRRKQMD

SEQ ID NO: 744 - protein, 70 aa, Artificial Sequence
  Computer-generated peptide variant
LLRWLCRMLKKITRLLERKARVWFKALVMAKRPKKLYRRVRLKAREKQAARADMANLFDKEPALQEYALR

SEQ ID NO: 745 - protein, 40 aa, Artificial Sequence
  Computer-generated peptide variant
FWRWLRKFLKIFKHDLIDRRLLCGICALCNRLRAARLRLF

SEQ ID NO: 746 - protein, 43 aa, Artificial Sequence
  Computer-generated peptide variant
LFRLFKKLLKRIKCACLCMAKENPSLLTHRIHKLAPKRDMKAK

SEQ ID NO: 747 - protein, 42 aa, Artificial Sequence
  Computer-generated peptide variant
RLKWLTRYIRRYSRRHWAYWKAALRLHRARVSHLCRKAKAQQ

SEQ ID NO: 748 - protein, 46 aa, Artificial Sequence
  Computer-generated peptide variant
RIRLMKKLYKLMRKCGGAKKAMLVVSAMDAMDLKLAWCLDLAMRKK

SEQ ID NO: 749 - protein, 25 aa, Artificial Sequence
  Computer-generated peptide variant
LYRLLKKFYKKLNKQRFLRGAGCKA

SEQ ID NO: 750 - protein, 30 aa, Artificial Sequence
  Computer-generated peptide variant
KLRLLKKWLKRFRRDYLAIDRNFRDALLTA

SEQ ID NO: 751 - protein, 36 aa, Artificial Sequence
  Computer-generated peptide variant
FIRMWKRWFKRIKRAHLKKLTLHIKQARLASLFHAP

SEQ ID NO: 752 - protein, 34 aa, Artificial Sequence
  Computer-generated peptide variant
FIKFFTRMIKKLNRLRPLLLQKMRASLKSKRVAM

SEQ ID NO: 753 - protein, 31 aa, Artificial Sequence
  Computer-generated peptide variant
KLKWLNKLIRRIRHLDRLAVDFGLAFAIRQL

SEQ ID NO: 754 - protein, 93 aa, Artificial Sequence
  Computer-generated peptide variant
LFKLMNRYIKRLRKQAKEKLAVLRAMALDRKIMMAEAIASKAKQAKKMAAEKAASKQTAWLMRAFADKKKLAFLARLHKNWFLRLRSPGHRKA

SEQ ID NO: 755 - protein, 51 aa, Artificial Sequence
  Computer-generated peptide variant
KLRMLRRYLRKFRKARQMRIPLLKKAFVKPLFACTWRWDCLDRAGAYLKNL

SEQ ID NO: 756 - protein, 62 aa, Artificial Sequence
  Computer-generated peptide variant
KFRMLRRMIRKIKPKCLRLAKAWMRLKSYWRLLRKLAAYTYKKNYTQIRSATTLIDLRHIRA

SEQ ID NO: 757 - protein, 45 aa, Artificial Sequence
  Computer-generated peptide variant
FFKYLKRFWKRLKKADWCEKMLAEKAKFNKYLCLGAMAAKWQKRR

SEQ ID NO: 758 - protein, 53 aa, Artificial Sequence
  Computer-generated peptide variant
RMKFFPRFLKKFKPKARNRQLAKRAKKRALKHHLQAAAKRKLAEWLAWLEKLW

SEQ ID NO: 759 - protein, 44 aa, Artificial Sequence
  Computer-generated peptide variant
RLKWLPKLLRFLKTLRRNLKPWVKALMLKDLKKALELACGAMSE

SEQ ID NO: 760 - protein, 94 aa, Artificial Sequence
  Computer-generated peptide variant
LLKWFRRLMKLLKRLLLIMRKHHNDPKLYHQRVMAKHADANKPKYAKMLRKQACPRRWLDHEAQLQKKIIATAYKVPRARLNLTCLRIAKRRFY

SEQ ID NO: 761 - protein, 27 aa, Artificial Sequence
  Computer-generated peptide variant
KWKFIKRLLKRLRHDMACDPKLYAIAN

SEQ ID NO: 762 - protein, 38 aa, Artificial Sequence
  Computer-generated peptide variant
KLKMYKRFMRLLKPAANPARMKKCAENKACEICYKLLW

SEQ ID NO: 763 - protein, 20 aa, Artificial Sequence
  Computer-generated peptide variant
KWKLLRKWYKFMKHFALKAS

SEQ ID NO: 764 - protein, 23 aa, Artificial Sequence
  Computer-generated peptide variant
YMRLLKKYMRMLKRAPFLHARKG

SEQ ID NO: 765 - protein, 56 aa, Artificial Sequence
  Computer-generated peptide variant
FYRFLRRFFRFLKSVKKKAWKKRIDMYMLLLLQAPLETKAILFKKRLKLITLRTFK

SEQ ID NO: 766 - protein, 36 aa, Artificial Sequence
  Computer-generated peptide variant
KFRFIRKYLKFLKCTALAKAWRAFRKFLWKCGQAYR

SEQ ID NO: 767 - protein, 61 aa, Artificial Sequence
  Computer-generated peptide variant
KLKYWKRLLRLMTRLRYLAIIRDILYYLLLPLKKKRISLLRKSDKASCKRCLENNLQRHAA

SEQ ID NO: 768 - protein, 40 aa, Artificial Sequence
  Computer-generated peptide variant
FLRILRRILKLLRKRDCCFRAHKETLWACRQRLCRHLAQQ

SEQ ID NO: 769 - protein, 22 aa, Artificial Sequence
  Computer-generated peptide variant
KLKYLRKWFRRLKHMLCGLAAK

SEQ ID NO: 770 - protein, 85 aa, Artificial Sequence
  Computer-generated peptide variant
FYKIIRKMMKILQSDGAVAFLNYDKKHQRWQRKAALLKLLAAKWTRKLPASKWLKKKAARCAKKIVKFERWLKKFKLKKVNKLKQ

SEQ ID NO: 771 - protein, 36 aa, Artificial Sequence
  Computer-generated peptide variant
RYRWLRRWFRLYSRDGLKTLGNQLKKRLLVAGPLKR

SEQ ID NO: 772 - protein, 27 aa, Artificial Sequence
  Computer-generated peptide variant
LLRMWQKYLKLLKRRSRQGPMRLAIGF

SEQ ID NO: 773 - protein, 73 aa, Artificial Sequence
  Computer-generated peptide variant
RFKFLRRIMRIMQKKALLALSAIYFSALRIAARKFAQQLRASMASAKWRGKLKTAKSKIKRPLKPVKNLALAQ

SEQ ID NO: 774 - protein, 36 aa, Artificial Sequence
  Computer-generated peptide variant
LIRIWRRFLRKMCTFLLAAMLAARRSKLNKWFGIRN

SEQ ID NO: 775 - protein, 55 aa, Artificial Sequence
  Computer-generated peptide variant
KMKWYKKLWKRLNKMNLAHLRQKLFKKLYMSDGAAAVCRLELRLWQKRKLQPATT

SEQ ID NO: 776 - protein, 64 aa, Artificial Sequence
  Computer-generated peptide variant
KIKYFKRLMKLFKNLLRRAANRRSPLEAANCAGGKVDPLALAARKRQGKHTKTLILKLDNKIKD

SEQ ID NO: 777 - protein, 47 aa, Artificial Sequence
  Computer-generated peptide variant
KYKLLRRLFRLMHRWGASQLQLAGDNAKRLWFARVRKQLYLRKTREQ

SEQ ID NO: 778 - protein, 56 aa, Artificial Sequence
  Computer-generated peptide variant
FLKWYKKWLKKLCKSDAAALKRRELATVALGRFFCKALASQCRSRAKTVKKLWSRK

SEQ ID NO: 779 - protein, 36 aa, Artificial Sequence
  Computer-generated peptide variant
KIKLLPKFLRIFKRFFRLDWYEKAAAKKWLGLQIRL

SEQ ID NO: 780 - protein, 33 aa, Artificial Sequence
  Computer-generated peptide variant
MLRLIKRIYKKWKQDLAYMGAKYPWLKAHRARL

SEQ ID NO: 781 - protein, 32 aa, Artificial Sequence
  Computer-generated peptide variant
MLRYLPRLYKLFPCREKRPGLETRALKKALDV

SEQ ID NO: 782 - protein, 45 aa, Artificial Sequence
  Computer-generated peptide variant
KLKLYRKFLKFLKKKAAIGRAIPKWALAKLGACALDDLITKQFTE

SEQ ID NO: 783 - protein, 43 aa, Artificial Sequence
  Computer-generated peptide variant
KLRIFRKWLRRLKQWFLILKYAYHAMHAFALYRRICRKFKGKN

SEQ ID NO: 784 - protein, 70 aa, Artificial Sequence
  Computer-generated peptide variant
KFRWYRRYYKLFCQAHDLCAKCMPFCRIIIKRRLRLLVAGKKHAAAFAKKKARRRLGKDAQKFNAKQNFA

SEQ ID NO: 785 - protein, 20 aa, Artificial Sequence
  Computer-generated peptide variant
LYKFIRKLWKIFKTLGALSR

SEQ ID NO: 786 - protein, 72 aa, Artificial Sequence
  Computer-generated peptide variant
KIRFFKRLLRMYSRAAYYAHARLLFCYFEADAAKREVYRLSAALIGELRLLPRARDRIHQRCQARTKQRLAG

SEQ ID NO: 787 - protein, 61 aa, Artificial Sequence
  Computer-generated peptide variant
IIKFLKRFIKKWHTLSPGAMKRAYVNKLSYLLHLKMLRKFQRWKLARKRRAKKLIKLPWFT

SEQ ID NO: 788 - protein, 42 aa, Artificial Sequence
  Computer-generated peptide variant
MMRLLTKILRLLKKLRWAYFHRGARQYLKTAFKDEKGWRRKF

SEQ ID NO: 789 - protein, 38 aa, Artificial Sequence
  Computer-generated peptide variant
KWKFYTRFLRYIQRIRKLFYAAIYKWRTAAPLLRKKAH

SEQ ID NO: 790 - protein, 89 aa, Artificial Sequence
  Computer-generated peptide variant
RWRFLKKLLKLMRKQYWHHYALARRAREKLNFKMLKWRDKKKHRRLLIPLLLIPRRCPLKHAAWMRKGFWLPGWLPALTWNADNLRFAI

SEQ ID NO: 791 - protein, 32 aa, Artificial Sequence
  Computer-generated peptide variant
RIKLLKRLFKMFRKPKSQAALPGNKPATCWRA

SEQ ID NO: 792 - protein, 90 aa, Artificial Sequence
  Computer-generated peptide variant
ILKLMRRLLKKLCQAKAEFAAEAVADWRSLWARAKRALQTLGSLIMAIPFRRRPKVIAKVPQMLCRAPLRRLAGFWAAPSKIRGKRRKHR

SEQ ID NO: 793 - protein, 41 aa, Artificial Sequence
  Computer-generated peptide variant
KLKFFRKMFKKFKRRALRRDLLLRGWNAHFGIGKIMAALKW

SEQ ID NO: 794 - protein, 24 aa, Artificial Sequence
  Computer-generated peptide variant
LLKFMKRLIKWLKSLLRHHGRRAT

SEQ ID NO: 795 - protein, 22 aa, Artificial Sequence
  Computer-generated peptide variant
KYKFWHKFLKRWKNNLALLAPA

SEQ ID NO: 796 - protein, 22 aa, Artificial Sequence
  Computer-generated peptide variant
KIKLLTKLLRFLNSVVGRLRIR

SEQ ID NO: 797 - protein, 71 aa, Artificial Sequence
  Computer-generated peptide variant
IYRYWTKLYRWWRRKAKCAVKGADKRTCKPRAKTKFMALSLKMLALARAVDRLAWWKSSRAPAEAEAPIRR

SEQ ID NO: 798 - protein, 38 aa, Artificial Sequence
  Computer-generated peptide variant
YYRMITRIWRRLSKKPAKWWQAKALFALKTDALGKKKF

SEQ ID NO: 799 - protein, 29 aa, Artificial Sequence
  Computer-generated peptide variant
RFRYLRRIYRRYSRLAKKSAKAICAYAAY

SEQ ID NO: 800 - protein, 65 aa, Artificial Sequence
  Computer-generated peptide variant
FMKLFKRFLRFLTNWRAIKDKLARYQLKLQCPRRRRKLRQKVLLGYCRLDYKAGACLDACLLAPI

SEQ ID NO: 801 - protein, 68 aa, Artificial Sequence
  Computer-generated peptide variant
KLKYFRRMLKKYRKVAPIARKWHLEKLNIVKTHRACNRALTAKLLPLFMLLWKYRKDVRAHKVLKLAG

SEQ ID NO: 802 - protein, 24 aa, Artificial Sequence
  Computer-generated peptide variant
KFKLLNKFIRLLHKRIHKWADKAT

SEQ ID NO: 803 - protein, 92 aa, Artificial Sequence
  Computer-generated peptide variant
IMRLFCKLFKRWRRRAFANIYRGCFLLTLPNDLKCCKESICIKFLKRHLLHALMAAMKGRRTAKAITAAQVRAKLLIVLLEIRAAALRKLLK

SEQ ID NO: 804 - protein, 39 aa, Artificial Sequence
  Computer-generated peptide variant
LFKLFKRWYRRIRKRRQRCYPTELISDMAATLFRALARL

SEQ ID NO: 805 - protein, 20 aa, Artificial Sequence
  Computer-generated peptide variant
LFKFLHKILRKLKQNKSLTI

SEQ ID NO: 806 - protein, 86 aa, Artificial Sequence
  Computer-generated peptide variant
LYKILHKMLKRLRNLSARVRTKHWGLKVDAAPKKILNLREALPYLRDIAHKKLRIKWFKLWNNELWSLAAMHRKLRMSHLKYRRKD

SEQ ID NO: 807 - protein, 33 aa, Artificial Sequence
  Computer-generated peptide variant
RLKLLKRMLKKIQKDQQCSATNAKVQARFAKNL

SEQ ID NO: 808 - protein, 20 aa, Artificial Sequence
  Computer-generated peptide variant
KWRLLNRYLRILKRGLNMDA

SEQ ID NO: 809 - protein, 55 aa, Artificial Sequence
  Computer-generated peptide variant
RYRWFTKFLKKFTPWAEVKKKLLARLDILGKSMFKKRALQAAKLRFKQTTRIAWL

SEQ ID NO: 810 - protein, 43 aa, Artificial Sequence
  Computer-generated peptide variant
KLRMMKRYYRKLKRMLLLDTRWHAAALADYALKLACLHKSGKL

SEQ ID NO: 811 - protein, 48 aa, Artificial Sequence
  Computer-generated peptide variant
LWKLFQKIIRYYCRKRWLKKKAPRTVAMRPPEAALKACVDLLRKMKKL

SEQ ID NO: 812 - protein, 56 aa, Artificial Sequence
  Computer-generated peptide variant
LFRLYKKIIKRLHNLIKLKLKALKAQKMRLKVKSMLLLRRLGGDAKRYERMPCWGY

SEQ ID NO: 813 - protein, 80 aa, Artificial Sequence
  Computer-generated peptide variant
YIKWFKRLYRKLNKCAVYRCRDAKFKLLFKCHQGCLLRWFDEKFCRALLLLKRFLLTPVTKAKAMKALAQAKRRKDWRCA

SEQ ID NO: 814 - protein, 29 aa, Artificial Sequence
  Computer-generated peptide variant
YLRLYSKFWKRYRRLSPHAKSLKPRDLPA

SEQ ID NO: 815 - protein, 51 aa, Artificial Sequence
  Computer-generated peptide variant
LLKWIKRILKRLRKYAAANIILYLRAIQTRLDLINRREREVCRKALCMAWP

SEQ ID NO: 816 - protein, 37 aa, Artificial Sequence
  Computer-generated peptide variant
RLRLFTRLMRKFPQKAALAFEANRTNFAKRKALPAGY

SEQ ID NO: 817 - protein, 69 aa, Artificial Sequence
  Computer-generated peptide variant
RWRMLRRFIKKLCKFNGRETAAQRLKPLVALQRRAMKYELRMRFKLRDADRLIKCAVIDNQLKAHMRVK

SEQ ID NO: 818 - protein, 38 aa, Artificial Sequence
  Computer-generated peptide variant
KIKLYRKLLKKFKTTKNPSRRRLTCKYNLLLLAHNILS

SEQ ID NO: 819 - protein, 49 aa, Artificial Sequence
  Computer-generated peptide variant
KWKLLKRFMRFFRPKQLLLLQKCLFACLKRYLIRWWAFFRNWIRLMYKR

SEQ ID NO: 820 - protein, 63 aa, Artificial Sequence
  Computer-generated peptide variant
KWRWFCKFYRRLKQRLLQAPHKWETLAKRCLRAEALETAIVRKLRVNKRHKAGDLHRLKFLLM

SEQ ID NO: 821 - protein, 45 aa, Artificial Sequence
  Computer-generated peptide variant
RFRLIRRLLRRIKTLLLAQRRYTKMYLWRAKAAGEWRIKWLGHMD

SEQ ID NO: 822 - protein, 52 aa, Artificial Sequence
  Computer-generated peptide variant
WLKWLRRLFKKLKTRLVNLLALLDCRCKGEQKTGAKCYRGKKLRCLALLLQP

SEQ ID NO: 823 - protein, 31 aa, Artificial Sequence
  Computer-generated peptide variant
KYKFIRKLWRLLKRATALRFLGPITKTAELF

SEQ ID NO: 824 - protein, 23 aa, Artificial Sequence
  Computer-generated peptide variant
RLRFWCKILKYLRQHDCALRKAY

SEQ ID NO: 825 - protein, 82 aa, Artificial Sequence
  Computer-generated peptide variant
ILRILTRFLRKISPAREKRVLRLYRLAAPIRLKRLNLVARRIARANEGLKKLWWKYTRKEKKWMAWALTLKWPQILKLLKFR

SEQ ID NO: 826 - protein, 28 aa, Artificial Sequence
  Computer-generated peptide variant
LMKFFRKWFKKLKQKNARMPLLTARDLL

SEQ ID NO: 827 - protein, 29 aa, Artificial Sequence
  Computer-generated peptide variant
KLRLLKKLLRWWKCQAIWGAGLLRSKHEL

SEQ ID NO: 828 - protein, 27 aa, Artificial Sequence
  Computer-generated peptide variant
KFRMYRRLFKKLSKVNLVLEFLCELLR

SEQ ID NO: 829 - protein, 21 aa, Artificial Sequence
  Computer-generated peptide variant
LYKLLPKYMRKLSRNKLGRYN

SEQ ID NO: 830 - protein, 35 aa, Artificial Sequence
  Computer-generated peptide variant
KLKFWQKYWRYFRRARAGLMVLKTSLVERARARLK

SEQ ID NO: 831 - protein, 40 aa, Artificial Sequence
  Computer-generated peptide variant
YLRLWHRLLKRYNCAKSKKVMKHRVWAAKWAIWYVAKARH

SEQ ID NO: 832 - protein, 51 aa, Artificial Sequence
  Computer-generated peptide variant
KLKLIKRYFRLMRRWMPGAWLKAALHDKRSCTLCRAREKLDKKLDTRLESN

SEQ ID NO: 833 - protein, 50 aa, Artificial Sequence
  Computer-generated peptide variant
KFRWFKKFLKFFSKRNRNAKAKNLLYRALPAFLAAARLQKKNKKETHHRL

SEQ ID NO: 834 - protein, 67 aa, Artificial Sequence
  Computer-generated peptide variant
KWKWYKRYLRRFQSLLCLKLDKLALAKKMHSHECLLRKLLVISKLMDSQRLKRIAVCALKRFIMDRR

SEQ ID NO: 835 - protein, 95 aa, Artificial Sequence
  Computer-generated peptide variant
RLKFLKKWFRLFKKGCKRARAAKTAVRDVRKLPATPVGGCHNPAYELAGAAKLCRRRAAPKKQLRRKRKLCLQALVVFHIRMKRSRRRWLAAAWD

SEQ ID NO: 836 - protein, 55 aa, Artificial Sequence
  Computer-generated peptide variant
YIRWLSRFLRKLRKLGFHGSLDAFRDIRRKAKKTLAAMMRQDRKKAKKLTHGTLL

SEQ ID NO: 837 - protein, 46 aa, Artificial Sequence
  Computer-generated peptide variant
RLKLLKKLLRRWKRKKDRAVELLMLHVLRKVLKLKPHPANARSMDA

SEQ ID NO: 838 - protein, 92 aa, Artificial Sequence
  Computer-generated peptide variant
MMKYMRRFMKKLNSWKSLACCQLKEKRKVIGSMKLLNCRWDKWLRKKRWVRARGQALIDLRARLLNALGKMREAAQKAACQRNAANWLRAHA

SEQ ID NO: 839 - protein, 30 aa, Artificial Sequence
  Computer-generated peptide variant
LIKLYKRWLRKLSRAKFDNFEGADAFLLYA

SEQ ID NO: 840 - protein, 40 aa, Artificial Sequence
  Computer-generated peptide variant
FYKFMKKLLKRFPHALSRKSERAEAAAATKLEQQYKRGYR

SEQ ID NO: 841 - protein, 43 aa, Artificial Sequence
  Computer-generated peptide variant
IYKLFRKLMRKLKCEHLAAALGKWLRRSLYKFGPMLWKRILKA

SEQ ID NO: 842 - protein, 45 aa, Artificial Sequence
  Computer-generated peptide variant
RMKFYKKFLKLIRKALLSLCMRLHVAWRCSLHKRDAAAKNREAAR

SEQ ID NO: 843 - protein, 41 aa, Artificial Sequence
  Computer-generated peptide variant
KIKLWRRMLKYWKHKRAWLRLKQKLARADAATWNSNGYPGK

SEQ ID NO: 844 - protein, 57 aa, Artificial Sequence
  Computer-generated peptide variant
LLRFLKRLLRKMRKQHHKRYRHRLDARFHSAKERLARNFAWGLAFLPLKKRRVCWAR

SEQ ID NO: 845 - protein, 30 aa, Artificial Sequence
  Computer-generated peptide variant
MLKYFHKYLKMFRKAARYMKAWLRERLLSE

SEQ ID NO: 846 - protein, 47 aa, Artificial Sequence
  Computer-generated peptide variant
KLKIITKLWKKLRKNHIKRKLHSGLRLEALENAAPLFLRLRLCKDAF

SEQ ID NO: 847 - protein, 52 aa, Artificial Sequence
  Computer-generated peptide variant
LLRIITRFLKFFKKALFHNLRPLYNSKKRERKRARLRVLNLRSIRFNKMKAL

SEQ ID NO: 848 - protein, 65 aa, Artificial Sequence
  Computer-generated peptide variant
IWRMWQKLLKWIKRGQVAMLAAKRLCALAKDMKVKDRLQKLLLARLKANGDGLLRRWDLYARATA

SEQ ID NO: 849 - protein, 59 aa, Artificial Sequence
  Computer-generated peptide variant
KLKYFHRYMKKLRCAACWAYQLGKAKLLARKSVKRAKANFWFLHRYFVRRRLKLKVLVK

SEQ ID NO: 850 - protein, 34 aa, Artificial Sequence
  Computer-generated peptide variant
MYKFLRKMLRKFSRPLAPSRALHPKMAFAKRVAL

SEQ ID NO: 851 - protein, 45 aa, Artificial Sequence
  Computer-generated peptide variant
FFRLIKRIFRLLPKGAQKAWKWRFIARRKLNKAAPMHKKRTAALM

SEQ ID NO: 852 - protein, 26 aa, Artificial Sequence
  Computer-generated peptide variant
LLRLYKRFLRWFRKNKFLQSSLAVPR

SEQ ID NO: 853 - protein, 74 aa, Artificial Sequence
  Computer-generated peptide variant
FFKYLKKLFRFLRHHFLAKKKLLKRACMSKAVKKHLKKKEGRKNQMRAAERAWIYCLGRARKLFAWCFCSAEKQ

SEQ ID NO: 854 - protein, 60 aa, Artificial Sequence
  Computer-generated peptide variant
FMKFFRKLLRRWQRTRLKKAQRIAAKVCVKYAHASCLLRIAFRAQFWRASRLMIMRALTT

SEQ ID NO: 855 - protein, 41 aa, Artificial Sequence
  Computer-generated peptide variant
LFKMFNRLMKRLCNLRRAPRLRTHAQKANKDLKAGIAGPTL

SEQ ID NO: 856 - protein, 69 aa, Artificial Sequence
  Computer-generated peptide variant
KLRYFRKLFKYMRKSGGKLAKFANAKRKALYTKLEAWKVWALRPLLCAAKKLAAVLLRYHAWEFMRWYC

SEQ ID NO: 857 - protein, 56 aa, Artificial Sequence
  Computer-generated peptide variant
KLKLLRKFWKLFRCSLWEYRLCPPADLNTKRKRLARRYADLAKGVHLGAEARPFSK

SEQ ID NO: 858 - protein, 42 aa, Artificial Sequence
  Computer-generated peptide variant
KFRYIKKLLRLMNRDLMLLDCARYAWLKLAESNKFKHLQALK

SEQ ID NO: 859 - protein, 29 aa, Artificial Sequence
  Computer-generated peptide variant
WLRLLNKFFKMFRCAKHWRASIKKTHRAL

SEQ ID NO: 860 - protein, 60 aa, Artificial Sequence
  Computer-generated peptide variant
FYRFMCRLIRLWTCARLKRWTAGIKGRGRWACKLALDSLLMKKKDDYEARAKRTKLRRAL

SEQ ID NO: 861 - protein, 54 aa, Artificial Sequence
  Computer-generated peptide variant
FIRFLSRLLRRLKRKRRKFCWHKKQSATARSTPLKSKDFTALPALHAYVATRRK

SEQ ID NO: 862 - protein, 28 aa, Artificial Sequence
  Computer-generated peptide variant
LFKLYSRIIKLYRRLAWNLAVKLLDLRK

SEQ ID NO: 863 - protein, 43 aa, Artificial Sequence
  Computer-generated peptide variant
MLRFIRKLFRKLKRFYSLRARNHAKAIADQRFKLLLIRALIHK

SEQ ID NO: 864 - protein, 20 aa, Artificial Sequence
  Computer-generated peptide variant
FLKLWTRLWKKFCKFRRANL

SEQ ID NO: 865 - protein, 41 aa, Artificial Sequence
  Computer-generated peptide variant
LLRILQKFLRKFCKYHKYQLVKCNKLRAARHYLVRRHARAM

SEQ ID NO: 866 - protein, 29 aa, Artificial Sequence
  Computer-generated peptide variant
KWRLLHKFLKYLKKMKQTQRAKAPAVWGA

SEQ ID NO: 867 - protein, 33 aa, Artificial Sequence
  Computer-generated peptide variant
YLRMLHKLFRIWKRAKLKTSLAKRRALWAKFFK

SEQ ID NO: 868 - protein, 20 aa, Artificial Sequence
  Computer-generated peptide variant
KIRIFHRFFRRLKQAATAEL

SEQ ID NO: 869 - protein, 52 aa, Artificial Sequence
  Computer-generated peptide variant
FWKFLPRLWKRLRTIDRRGCYRVKMRLLPLCHAKEHRLARLLRLSTRALQEH

SEQ ID NO: 870 - protein, 71 aa, Artificial Sequence
  Computer-generated peptide variant
ILRIMRRFLRRYKKKRARAKRCKRKKVLVPPYESREAPKICYKPLLKLCGVARALYKAHAKQAMTAPLTPL

SEQ ID NO: 871 - protein, 37 aa, Artificial Sequence
  Computer-generated peptide variant
RLRFLRKWYKRLKPKNHNQRAMLMRCPILQRLALIGR

SEQ ID NO: 872 - protein, 42 aa, Artificial Sequence
  Computer-generated peptide variant
LYRWLKKIFRRFKRRRALELLKLKATIYLALMPRVRRVKCLE

SEQ ID NO: 873 - protein, 73 aa, Artificial Sequence
  Computer-generated peptide variant
LLKFLRRILKKFKKSALDLMAAREALLWRKALAALLWWETVMRRKLQGRKEYLFVNTKCAMKMLFVGARVSRR

SEQ ID NO: 874 - protein, 62 aa, Artificial Sequence
  Computer-generated peptide variant
RLKWLQKLFKLFRKLKLLREGDARECKARKIASLARALDNAKQWAHRRFIRRFRQHKLGGRA

SEQ ID NO: 875 - protein, 24 aa, Artificial Sequence
  Computer-generated peptide variant
KLRLMPRLLRKWHSLAKSGARYEK

SEQ ID NO: 876 - protein, 81 aa, Artificial Sequence
  Computer-generated peptide variant
RMKWFKKILRKLSRVCRIDRSDRNRLSKQPMRLQGAANASVANLKLLAKGLFAACRRRADKYAVALLDRRLRKFQSKLLLK

SEQ ID NO: 877 - protein, 70 aa, Artificial Sequence
  Computer-generated peptide variant
MIKFLPRYLRWLRRAVKEAFSTALSAGNLRLMVLIKLRAWEKRLLMYAKKEVRKMFRALAFKPFKFMKAP

SEQ ID NO: 878 - protein, 22 aa, Artificial Sequence
  Computer-generated peptide variant
RLRYISRLWRILRKCVLSLKLC

SEQ ID NO: 879 - protein, 20 aa, Artificial Sequence
  Computer-generated peptide variant
FMKLFKKLWRLLSRCLAASH

SEQ ID NO: 880 - protein, 21 aa, Artificial Sequence
  Computer-generated peptide variant
KMKLYKRLLKFLRKDNWKIAA

SEQ ID NO: 881 - protein, 41 aa, Artificial Sequence
  Computer-generated peptide variant
RIRFMRRIIKKLKRYTLEAKKHNKACLKLIALRLLRLAARH

SEQ ID NO: 882 - protein, 32 aa, Artificial Sequence
  Computer-generated peptide variant
KLRLIRKLFKFFCNKKAKRCSSALHALADQNL

SEQ ID NO: 883 - protein, 53 aa, Artificial Sequence
  Computer-generated peptide variant
LYRWLHKLMRYIQKSAGLMLRVAARAYKIRAWRFKKECLRARRTAIYMILRKR

SEQ ID NO: 884 - protein, 27 aa, Artificial Sequence
  Computer-generated peptide variant
KLKYIKRLLRKWKPWAQKGMTLCAGGA

SEQ ID NO: 885 - protein, 41 aa, Artificial Sequence
  Computer-generated peptide variant
FLKLLTRLFKIFKNVRKRREAAADRFANRNDCAAKSIALAV

SEQ ID NO: 886 - protein, 60 aa, Artificial Sequence
  Computer-generated peptide variant
KLRLLHKWFKLFRRKRKGDGNKPKAAIVNAVLAAKLRVLRYATLNLCLLWGLLRSTHWKK

SEQ ID NO: 887 - protein, 23 aa, Artificial Sequence
  Computer-generated peptide variant
LFKYIRKLLKRMKTAIDLILSAK

SEQ ID NO: 888 - protein, 31 aa, Artificial Sequence
  Computer-generated peptide variant
FLKFFRRFLKRMKCRKALEMGGVALLGRLTR

SEQ ID NO: 889 - protein, 22 aa, Artificial Sequence
  Computer-generated peptide variant
LLRLIKRLWKIYTHWANLRKPL

SEQ ID NO: 890 - protein, 26 aa, Artificial Sequence
  Computer-generated peptide variant
LFKWIRRMLRRLKKAGALWMQKLCTV

SEQ ID NO: 891 - protein, 62 aa, Artificial Sequence
  Computer-generated peptide variant
WFRYFRKLLKLMPRPKQLNSLRNKCFAASRILVRLYKKLGEARAALPYCPMTALAERTRRAR

SEQ ID NO: 892 - protein, 44 aa, Artificial Sequence
  Computer-generated peptide variant
FMKIFKRLMKKFSRATLFPMRKKALKLAKLLGMLNDKKKSLNMG

SEQ ID NO: 893 - protein, 81 aa, Artificial Sequence
  Computer-generated peptide variant
KLKILRKLMKLLRKAALTGWAKKMRMYHILNAAVIRKWWKKQLWAYALVKPCKNIYKARRIKMLLVGGKAYNEVRRKMPKG

SEQ ID NO: 894 - protein, 56 aa, Artificial Sequence
  Computer-generated peptide variant
LIKWWSRFWKKWRRRKAGPKYAALAYTSYKEWATLKKARARHTKAALQLWKCKARK

SEQ ID NO: 895 - protein, 38 aa, Artificial Sequence
  Computer-generated peptide variant
RFKFLKKLMRFYHRMKANLDKGAALKIRCFKNLLWADV

SEQ ID NO: 896 - protein, 35 aa, Artificial Sequence
  Computer-generated peptide variant
KYRIIPRYLRRIKRKRTGAGAQSRCLKNLALALKP

SEQ ID NO: 897 - protein, 40 aa, Artificial Sequence
  Computer-generated peptide variant
RFRFLRKYLRLLRHESALMLTCLPVYNRLPAEKQRAKGRF

SEQ ID NO: 898 - protein, 52 aa, Artificial Sequence
  Computer-generated peptide variant
RLKILRRILKRFPCPLIFRKQAYAKKLAYDKWFYEWDRLAKAAVGRRKHFAP

SEQ ID NO: 899 - protein, 23 aa, Artificial Sequence
  Computer-generated peptide variant
IWKMLKRWLRKMSKLLAKISNPL

SEQ ID NO: 900 - protein, 45 aa, Artificial Sequence
  Computer-generated peptide variant
KWKFISKLLKKWKKAAACVLERCKGWRWLLTSFKNAAALRDKCQL

SEQ ID NO: 901 - protein, 26 aa, Artificial Sequence
  Computer-generated peptide variant
IYKLIRRFIRLLRPDLLAGRRARNLP

SEQ ID NO: 902 - protein, 97 aa, Artificial Sequence
  Computer-generated peptide variant
KLRLYNRFMKIFRKCFSLKHRRVNALRKARAKWEALACNMRLKDYARQAAFLFRRWFLPGAAHKKECLHFLTFGAKLKAPLIAYLKHLATLILVQKF

SEQ ID NO: 903 - protein, 79 aa, Artificial Sequence
  Computer-generated peptide variant
IFKYLHKLLKLLQNAKYWKKQDRSLARRTRRAHGKAKGTADIAHAKYLHMQMYYILTLWFAKLQKICKKRKLYLKKLQL

SEQ ID NO: 904 - protein, 44 aa, Artificial Sequence
  Computer-generated peptide variant
RFRYMRRFFKLLQPRWSHQWAQCLARAAARARQAKRTLAQRARP

SEQ ID NO: 905 - protein, 87 aa, Artificial Sequence
  Computer-generated peptide variant
RFRYLKRLWRFLKKKRWMPALIKLLVAFGAAMARCHLMDHRRQLLLRATLKPAAPALIWMRCQFKLKCYFSRDMFRKAAHSADASRP

SEQ ID NO: 906 - protein, 60 aa, Artificial Sequence
  Computer-generated peptide variant
KLRMIRRLIKMLRKLAGRWRFGAKIVRMRQKARWQWLAKPAAGSAAAKRRGFRGMWRYCA

SEQ ID NO: 907 - protein, 88 aa, Artificial Sequence
  Computer-generated peptide variant
KWKMLKKILRLMKRGILKKQLGGACRLESWVKNAAGMRGMFLKQAAPSAWRGAQQSDAKRWLLRRRKAAFAKLLDMLALKAYTCALSP

SEQ ID NO: 908 - protein, 29 aa, Artificial Sequence
  Computer-generated peptide variant
LLKLLCKFLKKMRKCKNYAHQWTRLKDAA

SEQ ID NO: 909 - protein, 39 aa, Artificial Sequence
  Computer-generated peptide variant
KLKIMQRWIKRYQRDLRAILLRSKKALCRALVSAEFLRA

SEQ ID NO: 910 - protein, 31 aa, Artificial Sequence
  Computer-generated peptide variant
FLRWLCKYLRRLHRQLLEMLLQYEMKRKLKC

SEQ ID NO: 911 - protein, 36 aa, Artificial Sequence
  Computer-generated peptide variant
KLRMLTRLLKLYKRMLYKGHCKAARKVKFAVCFDKQ

SEQ ID NO: 912 - protein, 21 aa, Artificial Sequence
  Computer-generated peptide variant
FYRLWKKFLKFMRRYLQAAPK

SEQ ID NO: 913 - protein, 27 aa, Artificial Sequence
  Computer-generated peptide variant
MLKLLQRWIRKLPCTCHLAKRLPLIGK

SEQ ID NO: 914 - protein, 48 aa, Artificial Sequence
  Computer-generated peptide variant
WLKFLRRYWRFLRRHATVAKRLLMGRVFLAACGMEAELEQRTPALKRK

SEQ ID NO: 915 - protein, 34 aa, Artificial Sequence
  Computer-generated peptide variant
ILKLFRKMYRLFPKFLLQLLATLGWGASRLDKRS

SEQ ID NO: 916 - protein, 35 aa, Artificial Sequence
  Computer-generated peptide variant
LLRFFHRLMRLIRRGAKVRFRLKRLLHWQKRLELN

SEQ ID NO: 917 - protein, 29 aa, Artificial Sequence
  Computer-generated peptide variant
YLRYFKRWLKLMRTYLAAGFLSTKFWAKK

SEQ ID NO: 918 - protein, 100 aa, Artificial Sequence
  Computer-generated peptide variant
KIRFLRKLWRKLRSRLALRHCLPLRIAKAACCLARRQRSLCKVKLMIENPWLKKSKLDSREFKGYAVKHIALIQQRAMNQKREERCTRSQIKALRSLLAI

SEQ ID NO: 919 - protein, 29 aa, Artificial Sequence
  Computer-generated peptide variant
LYKLFRKFLKRLPKQPMRILSKPMCAKLY

SEQ ID NO: 920 - protein, 23 aa, Artificial Sequence
  Computer-generated peptide variant
LWRFLRRMWRRLRNQLGALAREK

SEQ ID NO: 921 - protein, 47 aa, Artificial Sequence
  Computer-generated peptide variant
RFRLWKRFLKLWSQTAQLWQKWRRYRPIIERLANKMKRAALYKARGG

SEQ ID NO: 922 - protein, 45 aa, Artificial Sequence
  Computer-generated peptide variant
MLKFLTRLFKLLKKQIANWWLALPWRNARVIKLKLRKSCRHRQLR

SEQ ID NO: 923 - protein, 43 aa, Artificial Sequence
  Computer-generated peptide variant
KLKWLCKYLKRFKRADKARLYHLRGSRQLHLMPMLLAAPCYRA

SEQ ID NO: 924 - protein, 25 aa, Artificial Sequence
  Computer-generated peptide variant
WFRLLQKFLKWLKRAGLCVRPMNKL

SEQ ID NO: 925 - protein, 77 aa, Artificial Sequence
  Computer-generated peptide variant
RFKLLKRLIRKLKTRNLLICSKLPWFAIRVGHIYKERCAYERKCLLLLNYRRLAAKREDARAPQTKRKRAMKSQTEL

SEQ ID NO: 926 - protein, 26 aa, Artificial Sequence
  Computer-generated peptide variant
RFRYLKKFLKRITRAFHLAAKWNLEF

SEQ ID NO: 927 - protein, 41 aa, Artificial Sequence
  Computer-generated peptide variant
MIRFFRKLWKRIHRFAMALKRKAPEKGLAAMAYVKHRTAAR

SEQ ID NO: 928 - protein, 23 aa, Artificial Sequence
  Computer-generated peptide variant
KLKLIHKIWKILRRAALCLNAQN

SEQ ID NO: 929 - protein, 26 aa, Artificial Sequence
  Computer-generated peptide variant
KLRFLSKFWRRYRTKAIPAALHLSWA

SEQ ID NO: 930 - protein, 25 aa, Artificial Sequence
  Computer-generated peptide variant
LLKLWKKLLKKFRRKGLDHLGLFAV

SEQ ID NO: 931 - protein, 35 aa, Artificial Sequence
  Computer-generated peptide variant
RYRLLKKILKRFPPLDKHGQAARRKLLVLVKTRAR

SEQ ID NO: 932 - protein, 38 aa, Artificial Sequence
  Computer-generated peptide variant
RMRFMRKFFKYLRRHCMPQFQLWLRLANRLALRHQLAA

SEQ ID NO: 933 - protein, 27 aa, Artificial Sequence
  Computer-generated peptide variant
LYRWYQKYFRKLNKRMLLAKLYLTHSA

SEQ ID NO: 934 - protein, 52 aa, Artificial Sequence
  Computer-generated peptide variant
RFRWFNRYYRKLRSKLCPSLHILCKSARHLAKRRKAEVMLTQCKQKRPLKAL

SEQ ID NO: 935 - protein, 85 aa, Artificial Sequence
  Computer-generated peptide variant
RLKYLNKLLKKLKKKCSACQQCRLKIAVKRAAADYLFPNFRLPWKLAWAILRWWYAGTSNKRCHKAKRKMSACAFRQWHHKRVKK

SEQ ID NO: 936 - protein, 71 aa, Artificial Sequence
  Computer-generated peptide variant
KMRLMCKFWKFLKKKLREKAKHWDKLRNAQSLLLLRGKHIKLSSKPARQWKEEVGLAAAKKVKDMRKFLEM

SEQ ID NO: 937 - protein, 61 aa, Artificial Sequence
  Computer-generated peptide variant
RLRFIKKFFRRLRSFALCKHYAAALMVPLVRKARRAKLLKRKSSNRNVWRWASANHDKQKL

SEQ ID NO: 938 - protein, 33 aa, Artificial Sequence
  Computer-generated peptide variant
RLRLFCRIFRWFRKRQFHPKARARTLIKLLLCA

SEQ ID NO: 939 - protein, 38 aa, Artificial Sequence
  Computer-generated peptide variant
FFRLYKKLIKLWSTARNCARRGHIKRLKMAQRANALKI

SEQ ID NO: 940 - protein, 91 aa, Artificial Sequence
  Computer-generated peptide variant
KLRFLRRILKFFRRKWHKFERKEASKQNILRLALASRRLAYWLSYLKRACMLSFRRELAKERFLAKRWTDAKPLRWIKKLLIVFSFIYGLT

SEQ ID NO: 941 - protein, 35 aa, Artificial Sequence
  Computer-generated peptide variant
LLRIFRRFFKFYRRDQKMSKLKKADAKQLLAKMGL

SEQ ID NO: 942 - protein, 28 aa, Artificial Sequence
  Computer-generated peptide variant
KFRLLRKIWKKICRHLAQLAGKEILALR

SEQ ID NO: 943 - protein, 34 aa, Artificial Sequence
  Computer-generated peptide variant
LLKLLRKIFKYIHRARQARTAKFRFLPEKELLAT

SEQ ID NO: 944 - protein, 47 aa, Artificial Sequence
  Computer-generated peptide variant
RWRFFTKLLRKWRKLKVRGWKRMLRNFCCDSCLLLWLRELSAKANAF

SEQ ID NO: 945 - protein, 82 aa, Artificial Sequence
  Computer-generated peptide variant
LLKMLRKFYRKMNTSKALARAAKASCLEKRNRKLHMALIAQVRKQCQKMKSALMAFVIKKKRRHLYIRAADKKQIYMLTAML

SEQ ID NO: 946 - protein, 39 aa, Artificial Sequence
  Computer-generated peptide variant
LYKLFRKWLKRFRTNNLLAKAHMRMRYQLECQECRLLLA

SEQ ID NO: 947 - protein, 22 aa, Artificial Sequence
  Computer-generated peptide variant
LLRFLPRLIKYWRKASVKKASQ

SEQ ID NO: 948 - protein, 43 aa, Artificial Sequence
  Computer-generated peptide variant
RFRLMRRWLKKLKRTSFRYILLLKVRSKTYALHFKEIAPLYAW

SEQ ID NO: 949 - protein, 45 aa, Artificial Sequence
  Computer-generated peptide variant
FFRLLRRMLRKFKPQAKVKPASAYPIEKKAAAKWTAEKKNLLKHA

SEQ ID NO: 950 - protein, 61 aa, Artificial Sequence
  Computer-generated peptide variant
LWKLLKKLFRFYKKPAKPFSKRDKMKLKLCWVAKAATAPPLLMNALTIKSVFMAMKRGRAD

SEQ ID NO: 951 - protein, 33 aa, Artificial Sequence
  Computer-generated peptide variant
LFRFMQKLLRIMKHKRIALAPAFLTKRPFARRL

SEQ ID NO: 952 - protein, 43 aa, Artificial Sequence
  Computer-generated peptide variant
RLKFMSKIWRRFKKKERALEKSQLLKARTLDHKNAIYRCLLCS

SEQ ID NO: 953 - protein, 61 aa, Artificial Sequence
  Computer-generated peptide variant
FFRIINRLYKFLKRAVAARKDAEYRSKPPKVAMWKHLLRLQVKKREKDDRRRYVYAALACA

SEQ ID NO: 954 - protein, 41 aa, Artificial Sequence
  Computer-generated peptide variant
KIRLYKRLLKKLKCGFALKESRPKRKKLALEAKSRWRLPLF

SEQ ID NO: 955 - protein, 20 aa, Artificial Sequence
  Computer-generated peptide variant
RMKLINKLLKKLKKLQNHNA

SEQ ID NO: 956 - protein, 50 aa, Artificial Sequence
  Computer-generated peptide variant
RIKFLNKMIRRLPKRTCLALLMWTALRKKCPVHFWALKANKRKALKFPLR

SEQ ID NO: 957 - protein, 59 aa, Artificial Sequence
  Computer-generated peptide variant
KLRLLHKLLRKWPNAADKVARRTPMGGRARRRIRCWRYAPMTNMYFLLLRLLATTSWAR

SEQ ID NO: 958 - protein, 28 aa, Artificial Sequence
  Computer-generated peptide variant
FIKLWCRLFRLMKRLEVWLERTFARKAK

SEQ ID NO: 959 - protein, 31 aa, Artificial Sequence
  Computer-generated peptide variant
KLKLLRKLMRFLKRGKEPIDDALHFLFNLKR

SEQ ID NO: 960 - protein, 45 aa, Artificial Sequence
  Computer-generated peptide variant
KWRYLKRIWKIMQSWALHLRILRLLDAHKRILKKLKEALARNLHL

SEQ ID NO: 961 - protein, 24 aa, Artificial Sequence
  Computer-generated peptide variant
FLKLLHRLMKKLKKYNRTAANIKV

SEQ ID NO: 962 - protein, 30 aa, Artificial Sequence
  Computer-generated peptide variant
WLKFFRRMLKLFCSWGKTARLRRHMLKLRG

SEQ ID NO: 963 - protein, 39 aa, Artificial Sequence
  Computer-generated peptide variant
FYRFMRRLFKLLCRKAKAILHQWTLRHDAKWRRTAKLRY

SEQ ID NO: 964 - protein, 28 aa, Artificial Sequence
  Computer-generated peptide variant
IYRLLPRLLKKWRPAKRTDACRTLSARR

SEQ ID NO: 965 - protein, 35 aa, Artificial Sequence
  Computer-generated peptide variant
KFRFLPKLMRKWRKHKELCIKALPLLMKATKRHAY

SEQ ID NO: 966 - protein, 66 aa, Artificial Sequence
  Computer-generated peptide variant
KMKWLKKLFKRICQSDRRAVEHSFPCAYLSALAACYLKKRVMLWYKNCRKKRSLKLKLRGKTWALA

SEQ ID NO: 967 - protein, 39 aa, Artificial Sequence
  Computer-generated peptide variant
MFRYLKKLFRWWRNKALKQYCKARLRQARYTAKWNSLGA

SEQ ID NO: 968 - protein, 44 aa, Artificial Sequence
  Computer-generated peptide variant
FLKFLCKIWKYMKKGLYSKLLRRPLLRLKLRYLGLRDGEALTAA

SEQ ID NO: 969 - protein, 56 aa, Artificial Sequence
  Computer-generated peptide variant
FLKLYRKYMRRMQSATMDLLAIKVFVCRRRLRRQRKKRWAYSDYARATLAAKSDAF

SEQ ID NO: 970 - protein, 23 aa, Artificial Sequence
  Computer-generated peptide variant
RFRWMQRLLRKLKHMAKLDLCYC

SEQ ID NO: 971 - protein, 49 aa, Artificial Sequence
  Computer-generated peptide variant
FLRFLCKLMKRLHRAVLRKYHVDRRKAEPYYRSNKVAELKCKALTHKRL

SEQ ID NO: 972 - protein, 32 aa, Artificial Sequence
  Computer-generated peptide variant
KLRFLRRLWKKLHHRLCDVLPHRFFWKLMLRC

SEQ ID NO: 973 - protein, 48 aa, Artificial Sequence
  Computer-generated peptide variant
KIRLICRMWRKFRRGIKAMSLMKLYVHMKKWALLAPSAKDCLAARKIR

SEQ ID NO: 974 - protein, 23 aa, Artificial Sequence
  Computer-generated peptide variant
FFKLLQKLLKRLRRSFPAREQSK

SEQ ID NO: 975 - protein, 33 aa, Artificial Sequence
  Computer-generated peptide variant
LFRMIRRLFKKLRQKACTAKDLRAALLRKWERA

SEQ ID NO: 976 - protein, 26 aa, Artificial Sequence
  Computer-generated peptide variant
RWKFWKKWLKLMSTAKAMACPRKLAK

SEQ ID NO: 977 - protein, 44 aa, Artificial Sequence
  Computer-generated peptide variant
RFRIWRKLWKFWRKDDKKLRGWALKECAIKVARFLGLALAMGTA

SEQ ID NO: 978 - protein, 85 aa, Artificial Sequence
  Computer-generated peptide variant
WIRFLRKMLKLYTKYKAEFWRALKAADKPAAKARGLKFYLIGKRRRVREALGEAKTAQCLLKKYWLLAQKGLHKMHYCGLVWIAT

SEQ ID NO: 979 - protein, 59 aa, Artificial Sequence
  Computer-generated peptide variant
YLRMFQKILKRLKCAMDWSKVKAAWFCADARKKARSKARTMVLNKVKYAPAKAKKLKSL

SEQ ID NO: 980 - protein, 54 aa, Artificial Sequence
  Computer-generated peptide variant
KIKLLTRWLKRLTKDEGKAPFKNSRMLKVLLAPRRRDQRRARHLLLKEIHFRIV

SEQ ID NO: 981 - protein, 34 aa, Artificial Sequence
  Computer-generated peptide variant
FLRLIKKLLKRLRSWCKEAVVYHREKRKLQAWAP

SEQ ID NO: 982 - protein, 25 aa, Artificial Sequence
  Computer-generated peptide variant
KFRMLQKMLRKLKKARAAYTNNDGA

SEQ ID NO: 983 - protein, 46 aa, Artificial Sequence
  Computer-generated peptide variant
RLRLFCRFFRRLKRPSIANAKRAVARYKKLHNEQWRWAVLKCLNKD

SEQ ID NO: 984 - protein, 40 aa, Artificial Sequence
  Computer-generated peptide variant
LMRIMRRMMKMFQKLKVDPKIARNTLLLRAAKLVKPGRKS

SEQ ID NO: 985 - protein, 56 aa, Artificial Sequence
  Computer-generated peptide variant
KWKYWTRFLRWMKSNYKKASKLLKLEANSTFRAKLALMRLRAQSKKAARGFFSADH

SEQ ID NO: 986 - protein, 40 aa, Artificial Sequence
  Computer-generated peptide variant
RLRWLKRFLRMMKRQAAALNEALKRFRMAATAATFVHNAK

SEQ ID NO: 987 - protein, 25 aa, Artificial Sequence
  Computer-generated peptide variant
RYRLFKRMIRLFTHKAFRASDAQKL

SEQ ID NO: 988 - protein, 24 aa, Artificial Sequence
  Computer-generated peptide variant
LIKMLKKLYKYLQRVETKCKLLAW

SEQ ID NO: 989 - protein, 37 aa, Artificial Sequence
  Computer-generated peptide variant
IFKLISRLLRKLKRKLNSKFSAFTKARGYLILAAMTL

SEQ ID NO: 990 - protein, 35 aa, Artificial Sequence
  Computer-generated peptide variant
RLKLLRKFIKFLRRFRLCFKMKLNQHKIANLGYAK

SEQ ID NO: 991 - protein, 35 aa, Artificial Sequence
  Computer-generated peptide variant
YIRFMRRLIKFLRQRKWARAHKAVLSQKKFRAAAL

SEQ ID NO: 992 - protein, 28 aa, Artificial Sequence
  Computer-generated peptide variant
KFRLLRRYLKMIRKQEQALRTRPRALLA

SEQ ID NO: 993 - protein, 35 aa, Artificial Sequence
  Computer-generated peptide variant
LFRYFQKFWRRLRKAKNKSKAYDYQALRALDARCK

SEQ ID NO: 994 - protein, 31 aa, Artificial Sequence
  Computer-generated peptide variant
LLKLLKKMMRKWKTYHKIRSAHHAKMKSALW

SEQ ID NO: 995 - protein, 20 aa, Artificial Sequence
  Computer-generated peptide variant
LFRFLRKLLKIYKKSDQARP

SEQ ID NO: 996 - protein, 49 aa, Artificial Sequence
  Computer-generated peptide variant
RLRLLRKIYKLLKRTALDDLKKTHQRALRKLISAARKFLLDPFLFRRSR

SEQ ID NO: 997 - protein, 36 aa, Artificial Sequence
  Computer-generated peptide variant
RYKLIKKIYKRFRRIDDQALELWLIWRALLAQHKMK

SEQ ID NO: 998 - protein, 88 aa, Artificial Sequence
  Computer-generated peptide variant
KMRLLKKILKRIRKNKLKVRIAYEKKMKTRFRTGKRWKHLKRVMYYDKLKRLELYLLSFLFATLGKHTASCVVALLILYAEKAICQAK

SEQ ID NO: 999 - protein, 38 aa, Artificial Sequence
  Computer-generated peptide variant
WLRLIHRWMRRLKQWLSLDNQARWRHAAWRLKLRQKSI

SEQ ID NO: 1000 - protein, 21 aa, Artificial Sequence
  Computer-generated peptide variant
KLKLLSKYMKRYRKPIFFGAL

SEQ ID NO: 1001 - protein, 25 aa, Artificial Sequence
  Computer-generated peptide variant
LMRLFRKIFRFLSRDRHAFAAGKTL

SEQ ID NO: 1002 - protein, 36 aa, Artificial Sequence
  Computer-generated peptide variant
RLRFWHRYLRKFRKKLALGYLMRHEAKARQTCLLGD

SEQ ID NO: 1003 - protein, 23 aa, Artificial Sequence
  Computer-generated peptide variant
RLKLLKKWLKYLPRKKFIALRDA

SEQ ID NO: 1004 - protein, 35 aa, Artificial Sequence
  Computer-generated peptide variant
RLRLLKRLLKKLKRLGKTMKYMELKSLRAELKNHR

SEQ ID NO: 1005 - protein, 45 aa, Artificial Sequence
  Computer-generated peptide variant
KWRMLHKIYKKLPHLGRMDAAAFRSRREAIAALRLHLLAKHLRLK

SEQ ID NO: 1006 - protein, 23 aa, Artificial Sequence
  Computer-generated peptide variant
RLKLFQRMLRFLKRMAAWATQVG

SEQ ID NO: 1007 - protein, 21 aa, Artificial Sequence
  Computer-generated peptide variant
RLRFYPKLIKKISKLMAANCA

SEQ ID NO: 1008 - protein, 38 aa, Artificial Sequence
  Computer-generated peptide variant
IMKYLKKFFRRWSRLPLLLRFRSLPHRKREAPNRHWAL

SEQ ID NO: 1009 - protein, 30 aa, Artificial Sequence
  Computer-generated peptide variant
ILKLWRKLIRKMKKMQLYGMRLPNRAWART

SEQ ID NO: 1010 - protein, 56 aa, Artificial Sequence
  Computer-generated peptide variant
KLKLMKRWYRLFRKADMWALGHGVVRLVKAKARREARRKESDAKRFQLHNKMRACA

SEQ ID NO: 1011 - protein, 31 aa, Artificial Sequence
  Computer-generated peptide variant
MWKLWPRFMRRIKRTLLLRALKARQGGANLK

SEQ ID NO: 1012 - protein, 21 aa, Artificial Sequence
  Computer-generated peptide variant
RIKWFKRLLKKLNHKSVANLL

SEQ ID NO: 1013 - protein, 50 aa, Artificial Sequence
  Computer-generated peptide variant
RLKLMRKWLKRLSCLKKALKVIYMLALKLGGPKAFQNTAMRKKLLMHGAA

SEQ ID NO: 1014 - protein, 32 aa, Artificial Sequence
  Computer-generated peptide variant
ILRWLKKWWKKLKCEFPRALRRAKLNPDEAFA

SEQ ID NO: 1015 - protein, 85 aa, Artificial Sequence
  Computer-generated peptide variant
KYKYFRKLLRRWRRKPLEFRRTNRWYLTLSAKLWKAENKVRQHWMRAKSRFVLFRKLKANAARARAEAYAWRKPYILVFKMLVFG

SEQ ID NO: 1016 - protein, 81 aa, Artificial Sequence
  Computer-generated peptide variant
RMKIFHRYIKRLQRLPNRYLLHKKAAKELAPWVKAAPKGAAHLLPQVERCLNARKPDSNNFKASFTLHRAVRRLKAYRKRK

SEQ ID NO: 1017 - protein, 48 aa, Artificial Sequence
  Computer-generated peptide variant
RLRLLRKFYRLLKKVTIERYYLSLCIAARHKKKVALWCASLIRKDLKA

SEQ ID NO: 1018 - protein, 73 aa, Artificial Sequence
  Computer-generated peptide variant
KMRLLRKYLRRFKRRKPEAAFAAALLFWRRYACDCSRVRPKYYVIRLWYAGLLRVARWLVRARPFQQRVLRNL

SEQ ID NO: 1019 - protein, 38 aa, Artificial Sequence
  Computer-generated peptide variant
FLRLLNRWFRKFKHRQKDPLHAEARALWHLKLLKQLRE

SEQ ID NO: 1020 - protein, 41 aa, Artificial Sequence
  Computer-generated peptide variant
IWKILKRMFRRLKKLRYKTLKLLQRVAILCVLELMQNSLKV

SEQ ID NO: 1021 - protein, 32 aa, Artificial Sequence
  Computer-generated peptide variant
LFKILNRYWKFMSKRKLRPAKPCAAHAMALFR

SEQ ID NO: 1022 - protein, 23 aa, Artificial Sequence
  Computer-generated peptide variant
WLRLYKRLFRKFTQALWADRLRK

SEQ ID NO: 1023 - protein, 67 aa, Artificial Sequence
  Computer-generated peptide variant
RFKLFTKFFKLWRKKPAKLALGWAMPQKTKFLRLLNLKAHVTGPALWPTVAHARAKAAAKWKYKRGS

SEQ ID NO: 1024 - protein, 21 aa, Artificial Sequence
  Computer-generated peptide variant
IIKLFRRWFRRMRQLLKALEA

SEQ ID NO: 1025 - protein, 24 aa, Artificial Sequence
  Computer-generated peptide variant
RLRLYCRYYKRLRCYLARAKCHAN

SEQ ID NO: 1026 - protein, 27 aa, Artificial Sequence
  Computer-generated peptide variant
KLKIWKKIIRKWKSGAWRDQRYAALLL

SEQ ID NO: 1027 - protein, 45 aa, Artificial Sequence
  Computer-generated peptide variant
FIKFLKRWLKLLRSALKCRQLRHKTVLLKMYPCLLWAAGGHKWKM

SEQ ID NO: 1028 - protein, 32 aa, Artificial Sequence
  Computer-generated peptide variant
MIRLINKLIKRLTKLEMAAKRLYGNRAWRLRS

SEQ ID NO: 1029 - protein, 34 aa, Artificial Sequence
  Computer-generated peptide variant
FMKFLRRLLRLFQCRRSCELKFHAFLAWLSRKTA

SEQ ID NO: 1030 - protein, 20 aa, Artificial Sequence
  Computer-generated peptide variant
KWKMLNRLLRKMPKTNLLWW

SEQ ID NO: 1031 - protein, 43 aa, Artificial Sequence
  Computer-generated peptide variant
LLKYLRRYYKRLKQHAPLRKRMKLHRPAKQSKCRLAHELIDRL

SEQ ID NO: 1032 - protein, 26 aa, Artificial Sequence
  Computer-generated peptide variant
IWKFFPRLLRRLTKCKAWLAQACNKA

SEQ ID NO: 1033 - protein, 31 aa, Artificial Sequence
  Computer-generated peptide variant
LLRYFHKFYKKFKRAKKYANAVLANDWKRAG

SEQ ID NO: 1034 - protein, 32 aa, Artificial Sequence
  Computer-generated peptide variant
KLRFWPRIMRKFKNRAAKMGAVRKADIALTWL

SEQ ID NO: 1035 - protein, 65 aa, Artificial Sequence
  Computer-generated peptide variant
KFRIYRRMLRIIKKMSLTAPPGLAFIRLRLHASIPAKRALRKLFCKLARYFLRKLLQKKIFCMLS

SEQ ID NO: 1036 - protein, 62 aa, Artificial Sequence
  Computer-generated peptide variant
YLRWYKKLLKRMKKSRTRHPIRLKKLGWLNKKQLLPAWYKASIPMKAARALLRKEHVFDLEP

SEQ ID NO: 1037 - protein, 65 aa, Artificial Sequence
  Computer-generated peptide variant
RMRWFRRIMKRLCRLLFKKAASQLKCNHFLKARDLKLYLRKAGTNWVCRLQYAACSHRVKARANF

SEQ ID NO: 1038 - protein, 27 aa, Artificial Sequence
  Computer-generated peptide variant
LFKLWCKLFRRLHHKLPCSLAVRWFRR

SEQ ID NO: 1039 - protein, 46 aa, Artificial Sequence
  Computer-generated peptide variant
KLRIFHRWLKFFRRAALTIKAARWILNNARPKARPAVGRADALTCV

SEQ ID NO: 1040 - protein, 96 aa, Artificial Sequence
  Computer-generated peptide variant
LFKLYKKFWKRLQNLRKMRLKCLRLAKAKRGREEWRAVKACCHRSKGNKLKYVLLKAKEQPFYRAKMIGKAFFAAAARRMYLIARQNCEHKRKRAK

SEQ ID NO: 1041 - protein, 24 aa, Artificial Sequence
  Computer-generated peptide variant
KMRIYCKLWKKLRHLLHRARLQAC

SEQ ID NO: 1042 - protein, 71 aa, Artificial Sequence
  Computer-generated peptide variant
FLKIINRLFKKLPRLTFGKKCRLKCTLKAQAYQAAETKAVFGRKRRLAWDMAKRPKKKKKLGQSLELEQAH

SEQ ID NO: 1043 - protein, 45 aa, Artificial Sequence
  Computer-generated peptide variant
RFKLWKRLLRLLHKRLRLKNIATAMHNESAKAQARLLGQHVEHSI

SEQ ID NO: 1044 - protein, 48 aa, Artificial Sequence
  Computer-generated peptide variant
FLKLYRKIFRLIKQNAIQMLIRFALHIKQLAIKLATLCRRDRRCLEAK

SEQ ID NO: 1045 - protein, 94 aa, Artificial Sequence
  Computer-generated peptide variant
KLKMLHRLLKRIRRKLIERYLQALAKEWRSGEKLRPRILMCAKKPFGMKLGAEKSWMTKSRKKHMAKRTAQAAGTDLKCEASAKLYFLRKAEMR

SEQ ID NO: 1046 - protein, 35 aa, Artificial Sequence
  Computer-generated peptide variant
KFRFFHRFWKLYRRHRLRLCRLMQHAPRRARLCLA

SEQ ID NO: 1047 - protein, 66 aa, Artificial Sequence
  Computer-generated peptide variant
RFRYLRRLLRLFKPKKRTCLQYCFAAQLDELQADRSEEKLRWAKYFKRIAHALAKHCGRKRRRKWN

SEQ ID NO: 1048 - protein, 36 aa, Artificial Sequence
  Computer-generated peptide variant
LLKLLKRYFRKFQNEPYYCLAGTRHHRYKDLKLKKA

SEQ ID NO: 1049 - protein, 82 aa, Artificial Sequence
  Computer-generated peptide variant
RIRYLKKWYKFLQRHDRGARIATRERYYHFRKATKKHKANTLTRLKRLCNLCKIKCALSCDNKAADEKKAMWLAKALPRRKM

SEQ ID NO: 1050 - protein, 20 aa, Artificial Sequence
  Computer-generated peptide variant
ILRMWKRYLRFYKRASKLFL

SEQ ID NO: 1051 - protein, 29 aa, Artificial Sequence
  Computer-generated peptide variant
LIKLLPKLYRIINRLAKYRRNLWMCRIKY

SEQ ID NO: 1052 - protein, 23 aa, Artificial Sequence
  Computer-generated peptide variant
KYKFLTKFLKLFQRPYLLLLIRN

SEQ ID NO: 1053 - protein, 20 aa, Artificial Sequence
  Computer-generated peptide variant
RYKLYSRWFKWLPKARARLV

SEQ ID NO: 1054 - protein, 36 aa, Artificial Sequence
  Computer-generated peptide variant
KFKLLKKIIRMLRHHAKHCNRAAKRLREKIAGAYLV

SEQ ID NO: 1055 - protein, 20 aa, Artificial Sequence
  Computer-generated peptide variant
KLRLLRRILKMWPQFKEGRL

SEQ ID NO: 1056 - protein, 45 aa, Artificial Sequence
  Computer-generated peptide variant
RLRLLNRYMKWLKRLCADGRAYHCCTCAKRAYYIRAAARDKLTKL

SEQ ID NO: 1057 - protein, 25 aa, Artificial Sequence
  Computer-generated peptide variant
FIRFLRKFMKLIKKYAHLKLLKNKL

SEQ ID NO: 1058 - protein, 65 aa, Artificial Sequence
  Computer-generated peptide variant
LMRMFRRLFKYFKRIKSKHAAKWMKRKCWLLKALLFKAVPKAAEVRRLKQLVRSSLRLRGWYFLV

SEQ ID NO: 1059 - protein, 92 aa, Artificial Sequence
  Computer-generated peptide variant
RFRFLKKLLRLLPTKKPDPYTEADCGLPSTREDLRRHRSLRLALKKRALFKRSHALTNKAGKDRWYKAVWADLKTFNKFPRRFLPKPKAPRL

SEQ ID NO: 1060 - protein, 78 aa, Artificial Sequence
  Computer-generated peptide variant
RMRFFKKYWRRLKPCWAGMYFLRATGRMTLKLRAYLWYIKLARGKRPRYAAAAGVRRVKALKQQLLHNAGACMIKKLS

SEQ ID NO: 1061 - protein, 74 aa, Artificial Sequence
  Computer-generated peptide variant
LWKMLRKFLRMMRKKKHILQAKTRLDYACKGVSTRGHVLTLLKLCCRAKRLRGCAKQKKKALCLNNNRIGKGDR

SEQ ID NO: 1062 - protein, 64 aa, Artificial Sequence
  Computer-generated peptide variant
FLRWLTKFIRMIKRIAIYRRHTRAGLRRAHTKAEGLAADAQAGALRAFARCKDKKFLRGRPPYK

SEQ ID NO: 1063 - protein, 49 aa, Artificial Sequence
  Computer-generated peptide variant
KIRFLRRWYKFLSKELAKFPARRRHLALSARHEMKNRRAITTAKAWRAL

SEQ ID NO: 1064 - protein, 30 aa, Artificial Sequence
  Computer-generated peptide variant
RLRFLQKLMKWYSHWDKWGRQLKWRALRAA

SEQ ID NO: 1065 - protein, 43 aa, Artificial Sequence
  Computer-generated peptide variant
RLRFFRRWFKLLRRRLALKNPGKRDKLTKALFQLAMRRAAREC

SEQ ID NO: 1066 - protein, 54 aa, Artificial Sequence
  Computer-generated peptide variant
FLRWLTRLLRRLRHRKLNAIPCLMNIRVTHKHAVRFMDETLLADRLLWKLTLKR

SEQ ID NO: 1067 - protein, 86 aa, Artificial Sequence
  Computer-generated peptide variant
RFRMYKRLYRRYTSIKAYAGLNPACYRDIRRKDARQVCTPKLKTRKLRPFAKHRRLCKSLYCRNKATCRASAALDALKAAVRAKVE

SEQ ID NO: 1068 - protein, 56 aa, Artificial Sequence
  Computer-generated peptide variant
KLRLLRKWFKRIRKLPNRMWLIAPRCKALAKVLKYIFALHRAQADQRITMALDLRY

SEQ ID NO: 1069 - protein, 29 aa, Artificial Sequence
  Computer-generated peptide variant
KWRLFRRLLRRFHQKRLLPPKKHDCLASL

SEQ ID NO: 1070 - protein, 44 aa, Artificial Sequence
  Computer-generated peptide variant
KLKYFTKLLRYIRNALRNNRSDYRRQLKMNFVLSALLRKSLRLI

SEQ ID NO: 1071 - protein, 34 aa, Artificial Sequence
  Computer-generated peptide variant
KFKWFCKFLKKFRKKLYLWGAAMLRYLKEQRASI

SEQ ID NO: 1072 - protein, 36 aa, Artificial Sequence
  Computer-generated peptide variant
LIRLYKKLMRLMRNFAALKKKAMAIRSRLLWEKLTK

SEQ ID NO: 1073 - protein, 23 aa, Artificial Sequence
  Computer-generated peptide variant
ILKMLTKLYKLLNQKRMRRKAWQ

SEQ ID NO: 1074 - protein, 26 aa, Artificial Sequence
  Computer-generated peptide variant
RLKLMKKLWKWLNCCKTKRLARVNNL

SEQ ID NO: 1075 - protein, 26 aa, Artificial Sequence
  Computer-generated peptide variant
KFRFLTKYLKLLPRRALLSERTVPFL

SEQ ID NO: 1076 - protein, 36 aa, Artificial Sequence
  Computer-generated peptide variant
KYRYFQKLLKFLKKRFAECCKLARYGSKFTLANAAK

SEQ ID NO: 1077 - protein, 34 aa, Artificial Sequence
  Computer-generated peptide variant
RLRLLNKYLKKFPKSAALRRSSWQLFDQVAIKFL

SEQ ID NO: 1078 - protein, 28 aa, Artificial Sequence
  Computer-generated peptide variant
KLKFYQKWFKKLCRAAKELHAIMLKCAA

SEQ ID NO: 1079 - protein, 27 aa, Artificial Sequence
  Computer-generated peptide variant
KFKFLPRILKLWKKMYAKAARRFACLD

SEQ ID NO: 1080 - protein, 20 aa, Artificial Sequence
  Computer-generated peptide variant
RMKFYSRLLRLYRRVPQAVA

SEQ ID NO: 1081 - protein, 38 aa, Artificial Sequence
  Computer-generated peptide variant
RLRLLKRYLKWFNKRRNNHAKAAIAGPKQFSLAMKQLK

SEQ ID NO: 1082 - protein, 21 aa, Artificial Sequence
  Computer-generated peptide variant
WFRILHKLMKYMKKVKLELAA

SEQ ID NO: 1083 - protein, 51 aa, Artificial Sequence
  Computer-generated peptide variant
LLRIFKKLWKLLRCRALNLYLKVRRARRLCAPAWLANLKKARALKLNHELK

SEQ ID NO: 1084 - protein, 48 aa, Artificial Sequence
  Computer-generated peptide variant
RMRLFQRLFRLYHPRLLKIKCRRLDTKLCAYNEQAFARKKKQKKLLHI

SEQ ID NO: 1085 - protein, 38 aa, Artificial Sequence
  Computer-generated peptide variant
RLKLFPKFMRKWRKLEKCAAHQRLIARLAKRHVLYLRT

SEQ ID NO: 1086 - protein, 32 aa, Artificial Sequence
  Computer-generated peptide variant
RIKLISKYFKKWKSCYRAWLFSANRTRLAALR

SEQ ID NO: 1087 - protein, 47 aa, Artificial Sequence
  Computer-generated peptide variant
RLKLLKRYIKFLKHSKSELLWAKAKGWTIMKPPKSDAERKDALAKAR

SEQ ID NO: 1088 - protein, 61 aa, Artificial Sequence
  Computer-generated peptide variant
LFRYIKKLFRLWTKFLAALLALAKWPKLFKEKPVPRKGDRKHDIGFGNARAPWARHKILRK

SEQ ID NO: 1089 - protein, 43 aa, Artificial Sequence
  Computer-generated peptide variant
ILKWWKKMLRKYRPLKNFNRFQRRCLLWKLAQACKKRLAACEL

SEQ ID NO: 1090 - protein, 79 aa, Artificial Sequence
  Computer-generated peptide variant
FFRLIKKLLRLFTKLAADVKRAKGHWLTAKKFEHKKHEARKKAPRYQNANHQKACLKRDGRLALRARKNKPRMRKLWQS

SEQ ID NO: 1091 - protein, 24 aa, Artificial Sequence
  Computer-generated peptide variant
LWKLLKRIFRKLRKLHCRLALDHR

SEQ ID NO: 1092 - protein, 47 aa, Artificial Sequence
  Computer-generated peptide variant
LWRLLHRFIRLMKPKRAGLYAKTKVIHRRLTDKLKRHDIALKHNEAH

SEQ ID NO: 1093 - protein, 20 aa, Artificial Sequence
  Computer-generated peptide variant
RYKMFKRYLRRFTQNLLLAE

SEQ ID NO: 1094 - protein, 58 aa, Artificial Sequence
  Computer-generated peptide variant
RLRWLQRLFRKFPRLEFPVQARRYVRNLATTLKHAFSRCYARARRDLKAARSRYLLWW

SEQ ID NO: 1095 - protein, 56 aa, Artificial Sequence
  Computer-generated peptide variant
RFRIFKRFLRKFRKQREWREKLCLTVRLGLRAFGLKKLNWTKIALLALGTFKSVVL

SEQ ID NO: 1096 - protein, 32 aa, Artificial Sequence
  Computer-generated peptide variant
KIRLLKKLLRKFRHVVLKYMWLQYLLSKRRNA

SEQ ID NO: 1097 - protein, 26 aa, Artificial Sequence
  Computer-generated peptide variant
RFKFLRRMLRMFKNYLLTYLLRWAKK

SEQ ID NO: 1098 - protein, 46 aa, Artificial Sequence
  Computer-generated peptide variant
KLRLLSKLLKFLKKRAILDRRAFNFNACRHKRQDAAIKLKIHNLKK

SEQ ID NO: 1099 - protein, 60 aa, Artificial Sequence
  Computer-generated peptide variant
FFKFLKRWFRKFKTADCMHLFGADFNRKTLMEKFINLMKRYLLRDILKDAKLKRAKLARK

SEQ ID NO: 1100 - protein, 28 aa, Artificial Sequence
  Computer-generated peptide variant
KLKFLRKLYKLLKRINLGWAFLFRKAQK

SEQ ID NO: 1101 - protein, 43 aa, Artificial Sequence
  Computer-generated peptide variant
KLKLFPKLMKKFSCKLLTTLEGQRYLKQVRPRLNARAILVLQA

SEQ ID NO: 1102 - protein, 91 aa, Artificial Sequence
  Computer-generated peptide variant
MLRWFSRIFRRLRRRAAKFARLLCCQALCFKFCHPKRQRRAWCVSHFAAPALLVFRRAKGATAADWLATLWVRACRKQARLALPTVHLRAK

SEQ ID NO: 1103 - protein, 51 aa, Artificial Sequence
  Computer-generated peptide variant
FLRWFSRLLRKINRHIVAKVQDRLRKANAAKVASLLRHAVTLAWKEAFRCA

SEQ ID NO: 1104 - protein, 80 aa, Artificial Sequence
  Computer-generated peptide variant
KFRLFCKLLRKLPPARPLLRRKLMERLRVNKAALKTLTALQLNQLDMGVLGKAYRSPHLRAKKTLGEMNILRRMGLKWAR

SEQ ID NO: 1105 - protein, 37 aa, Artificial Sequence
  Computer-generated peptide variant
KMRLLRRLFKKYRQADKDNTKALRHMWAGPLMARRAG

SEQ ID NO: 1106 - protein, 32 aa, Artificial Sequence
  Computer-generated peptide variant
LLKLWNKLLRRLQCLAVSFLLRNKDRKKEPTT

SEQ ID NO: 1107 - protein, 72 aa, Artificial Sequence
  Computer-generated peptide variant
KLKLLHKLWKFFQHKEALRAIVFLELKAYHDRKLAKRLLLTAFALNSQALGCAYCLIQNLRNFFRCKKKMYR

SEQ ID NO: 1108 - protein, 38 aa, Artificial Sequence
  Computer-generated peptide variant
LFRLFKRYWKLLRRKLKMAVKDAQFGKKHRAAYAADDK

SEQ ID NO: 1109 - protein, 40 aa, Artificial Sequence
  Computer-generated peptide variant
RYKMLKKIFKYWQRRHYDKALMLAGADQKRKYRFLLLLPA

SEQ ID NO: 1110 - protein, 36 aa, Artificial Sequence
  Computer-generated peptide variant
FFRLLPKWMKLYPKFARCACRKNLTNLAWLGAKRRL

SEQ ID NO: 1111 - protein, 71 aa, Artificial Sequence
  Computer-generated peptide variant
MLRLWPRFLKKLKSDRAKLAIIPEIRYYRKKLKYLDIKKERLTSCEAPFLCRLAAARYLIHDKIRLKLLSR

SEQ ID NO: 1112 - protein, 48 aa, Artificial Sequence
  Computer-generated peptide variant
MLKLMNRLLRKFRHTKALGKLRNMLSDKLKNRKIALWSLECPTAAVMK

SEQ ID NO: 1113 - protein, 48 aa, Artificial Sequence
  Computer-generated peptide variant
LWKFFKRFYRIWNKLRCNYQRKRKKFRFAAALAEPARMDLALAQAALL

SEQ ID NO: 1114 - protein, 25 aa, Artificial Sequence
  Computer-generated peptide variant
RLRLIKRLLRMFNRWGWAAQEKEVK

SEQ ID NO: 1115 - protein, 30 aa, Artificial Sequence
  Computer-generated peptide variant
IWKFMKRFLRRLKCLRYQASLLTDRKRLPC

SEQ ID NO: 1116 - protein, 90 aa, Artificial Sequence
  Computer-generated peptide variant
KWKLFCKFLRLYRRLAILAARRHAMYFRALLMETAEHRRCALLMDKRLLQYCAWIVIKKRLKSALKTIRFIYTTRRKTLMLRKFPARGVR

SEQ ID NO: 1117 - protein, 22 aa, Artificial Sequence
  Computer-generated peptide variant
LLKMIQRLLRRMHQRMALPAKA

SEQ ID NO: 1118 - protein, 34 aa, Artificial Sequence
  Computer-generated peptide variant
RWRYLHRLLKKLTTEWYKLLAWPCLHLARTWRAN

SEQ ID NO: 1119 - protein, 43 aa, Artificial Sequence
  Computer-generated peptide variant
WMRWLKRLWKKFQRHSAALCRKEAKWGRVIRLARAVQLDLRRL

SEQ ID NO: 1120 - protein, 52 aa, Artificial Sequence
  Computer-generated peptide variant
LFRYMRRFWRMLSKRAQKQELTYRLEAEREKKLARGQWRRKMHCLRAKALKL

SEQ ID NO: 1121 - protein, 79 aa, Artificial Sequence
  Computer-generated peptide variant
KLKLYRRLLRRFRKCLAYKFRLKYQDKYRCHTRLKNRQVTHWKSLMAAWKKLQRNQRKNLVPRERNHQGALLAAKQPDL

SEQ ID NO: 1122 - protein, 56 aa, Artificial Sequence
  Computer-generated peptide variant
RIRLYKRILRRYKPAAMSALGTTKHRLKKKLLKCSATTRVLQSKAYLNCRLSKRNR

SEQ ID NO: 1123 - protein, 39 aa, Artificial Sequence
  Computer-generated peptide variant
LIRLYRRWLRRLPRLAFARCRACLGGRIEAYYKKQAHPL

SEQ ID NO: 1124 - protein, 31 aa, Artificial Sequence
  Computer-generated peptide variant
LWRLLRKWYKFFKRTAVRKLAAAMLEFHEKW

SEQ ID NO: 1125 - protein, 72 aa, Artificial Sequence
  Computer-generated peptide variant
KFKLLRRLLKWLCRCQSVAHRSAVYWRSWLLLARRQGEIYLFRALRVQFWRKKIQYKERARRLTLAARYRPL

SEQ ID NO: 1126 - protein, 36 aa, Artificial Sequence
  Computer-generated peptide variant
RFKMIQRWIKRMHCYLKKRDFLRKDRQALLLAAVAW

SEQ ID NO: 1127 - protein, 51 aa, Artificial Sequence
  Computer-generated peptide variant
KLRIFKRLFKYFRKEFWKKRKHLALCSKLEDLKLLKLNKRDNAYWQAARVQ

SEQ ID NO: 1128 - protein, 58 aa, Artificial Sequence
  Computer-generated peptide variant
KWRLYKRLMRLMKTYKSNLLAFALDKKAEELEASKCLQRMCRHHKNRRRAFALLHDNW

SEQ ID NO: 1129 - protein, 47 aa, Artificial Sequence
  Computer-generated peptide variant
RLKLLCKYLKKYSRLRRLRGGFREWFKARTLRAHRIYFITVDASQAL

SEQ ID NO: 1130 - protein, 29 aa, Artificial Sequence
  Computer-generated peptide variant
LYRFLKKFLKKLTKVKRLAAYTEYVLFIY

SEQ ID NO: 1131 - protein, 23 aa, Artificial Sequence
  Computer-generated peptide variant
LLKFWKKYLKWIRRTAARQATAT

SEQ ID NO: 1132 - protein, 28 aa, Artificial Sequence
  Computer-generated peptide variant
RWRILHKMFKKFPKALIRLCIRLNALLM

SEQ ID NO: 1133 - protein, 52 aa, Artificial Sequence
  Computer-generated peptide variant
KWKLYHRFWRKLKNRLCMITTGKAAITANKACHALKQQGAMHKRKRLELKAL

SEQ ID NO: 1134 - protein, 69 aa, Artificial Sequence
  Computer-generated peptide variant
KFRYYRKLIKWFKKHFNPKQAPAKRALDRDRRARAPTRLPKNLKARMLRSLYRIANQIIWCSKRLLPLQ

SEQ ID NO: 1135 - protein, 31 aa, Artificial Sequence
  Computer-generated peptide variant
KFRFLKKLYRLWKKLALKTRCMPKLAAERAY

SEQ ID NO: 1136 - protein, 50 aa, Artificial Sequence
  Computer-generated peptide variant
KLKLLCKLIKFLQRAYVDANALLTYMLRKLQNHTEGKRRVAKHMRHKKKL

SEQ ID NO: 1137 - protein, 32 aa, Artificial Sequence
  Computer-generated peptide variant
RYKLMQRYFRRLNQLARLCHHKWRAAEASNRL

SEQ ID NO: 1138 - protein, 27 aa, Artificial Sequence
  Computer-generated peptide variant
MLRFLRKIMKWLKRWGKRAHWAAKACA

SEQ ID NO: 1139 - protein, 41 aa, Artificial Sequence
  Computer-generated peptide variant
FIKLFRKILRKFRPAVELARLYLLNKCRAAHDQRLWLAHKQ

SEQ ID NO: 1140 - protein, 26 aa, Artificial Sequence
  Computer-generated peptide variant
KFRLLPKLWKRFHKTLALIAHAKAVP

SEQ ID NO: 1141 - protein, 33 aa, Artificial Sequence
  Computer-generated peptide variant
KLRILNKLYKMWRRAASKRSWSGGCPALRKAHL

SEQ ID NO: 1142 - protein, 58 aa, Artificial Sequence
  Computer-generated peptide variant
RYKLLQKLFRRLNRDHVSRALLKYRVLILLARRGADLFKKKCMDRATAHCADKDAKCA

SEQ ID NO: 1143 - protein, 23 aa, Artificial Sequence
  Computer-generated peptide variant
RLRFFKKLMRRYSKGLATKAQLW

SEQ ID NO: 1144 - protein, 57 aa, Artificial Sequence
  Computer-generated peptide variant
KLKYFRRMFKLYRKLFVQRARAWANYWAAAHLKALKKAFMNGHLRMAKTLYYRLALP

SEQ ID NO: 1145 - protein, 36 aa, Artificial Sequence
  Computer-generated peptide variant
RFRILSKLFRRMRSDCAQAKILLKRACLGYKRHPKA

SEQ ID NO: 1146 - protein, 54 aa, Artificial Sequence
  Computer-generated peptide variant
KLKIIQRLLKKIRQSIALHQLPKAANLLQDERRWDRLLPAKVKAASEQKPNRFR

SEQ ID NO: 1147 - protein, 36 aa, Artificial Sequence
  Computer-generated peptide variant
FIRMLRRLLRLLHNRSHHRSLYVLRAALGQLEKLRN

SEQ ID NO: 1148 - protein, 44 aa, Artificial Sequence
  Computer-generated peptide variant
RFKLIRKWLRRWKKHAQKRLKLLYLFVRMMQDLREKKAFLHNLV

SEQ ID NO: 1149 - protein, 70 aa, Artificial Sequence
  Computer-generated peptide variant
YFKWLSRIFRKIKRKKRAKRKRAEILRFDLCNANTQIKLHVRDAPPKKTQKLMLALLHLKAMLFRPKPLL

SEQ ID NO: 1150 - protein, 24 aa, Artificial Sequence
  Computer-generated peptide variant
KLKWLRKWIKKLTQHIAKLTRLKA

SEQ ID NO: 1151 - protein, 28 aa, Artificial Sequence
  Computer-generated peptide variant
WLRIMRRLFKLYSRLLLRTRCCRRLLWR

SEQ ID NO: 1152 - protein, 28 aa, Artificial Sequence
  Computer-generated peptide variant
LFKFFQKLLKKMHRDKAKLARQECHLLA

SEQ ID NO: 1153 - protein, 29 aa, Artificial Sequence
  Computer-generated peptide variant
RLRFFPKYFRKLKKAAREIVKNTDLLGAI

SEQ ID NO: 1154 - protein, 63 aa, Artificial Sequence
  Computer-generated peptide variant
MWKMLRRYFRLLRKLLWGKWRKAYLKHALIDLGKCAGNVFLRNLARLMNIGLCHKRARGLSLD

SEQ ID NO: 1155 - protein, 66 aa, Artificial Sequence
  Computer-generated peptide variant
RLRFWPRLFRRWCRRRRHVNSKQKVCLRKKLPIEAIAKNRGNCALAAMDKARKHGWAAILLARLAF

SEQ ID NO: 1156 - protein, 35 aa, Artificial Sequence
  Computer-generated peptide variant
RMRLYPKFLKLFKQAIAEALKLKKAYRKHAKYKCL

SEQ ID NO: 1157 - protein, 57 aa, Artificial Sequence
  Computer-generated peptide variant
FFRLFRKMFKLLPKPYVGAKRMLMLRDGPLQTVAALAKALAGCLGKDKLRREPRRVR

SEQ ID NO: 1158 - protein, 33 aa, Artificial Sequence
  Computer-generated peptide variant
RFRILHKLFRKLRQCQRWLSALYKLIKLLWLLA

SEQ ID NO: 1159 - protein, 82 aa, Artificial Sequence
  Computer-generated peptide variant
LWRLFRKFWRRLRKKAEILFFNSYSASRMARMLMRLARTKLKKAFGIALANKADDLRLAKFRLFGKSEASAPRERRGYKRRY

SEQ ID NO: 1160 - protein, 68 aa, Artificial Sequence
  Computer-generated peptide variant
FWKILSRLLRMLSHKKNLYCLYKRVDLKRRPRKLIAGKDYPLAKKMLSGKRICKTLVMCLAAAKLMHK

SEQ ID NO: 1161 - protein, 50 aa, Artificial Sequence
  Computer-generated peptide variant
KLRLFRKYLKWLKCRRARDRWLAKLLRRFAPLRFLNMKFTVLPAARLWWM

SEQ ID NO: 1162 - protein, 52 aa, Artificial Sequence
  Computer-generated peptide variant
RYKFLTRYYRLIRRCLCCWCRAKAAAAMRWTFRSRARGAMRQKVLALKFIIK

SEQ ID NO: 1163 - protein, 55 aa, Artificial Sequence
  Computer-generated peptide variant
LWKFLKKWYKKLCKCKLVALSSGMMVLLLANAKKEIDKERSAIRLAAAYICAKWA

SEQ ID NO: 1164 - protein, 58 aa, Artificial Sequence
  Computer-generated peptide variant
RLRFLRRLLRFFNKCPARRPAHWRKASRLKRLILTMMRKTIPLAKTLGKARTPVRCIA

SEQ ID NO: 1165 - protein, 89 aa, Artificial Sequence
  Computer-generated peptide variant
YYRLFSRFFRKFKNLRKRLRSDDALAPHFARKKKACPVRSGCLLFLAEMKLACKLKQARVRPKKALTAMRYLVMKFALYDQLFLALFAN

SEQ ID NO: 1166 - protein, 63 aa, Artificial Sequence
  Computer-generated peptide variant
KLRYWRKLFRRWNTKKRWLLLKLCAQSRMALGYCEAPFNKRQWSKAYRRRIKAVRHAKLCLGA

SEQ ID NO: 1167 - protein, 26 aa, Artificial Sequence
  Computer-generated peptide variant
LLKILTRLFKMLKKHKMAATARAGFQ

SEQ ID NO: 1168 - protein, 31 aa, Artificial Sequence
  Computer-generated peptide variant
KFKIYRKFLKKYKTVAIAMFAFELLLIRKLR

SEQ ID NO: 1169 - protein, 71 aa, Artificial Sequence
  Computer-generated peptide variant
KIKYLQKFFKRFRRSLANNIVCCPSAAARTHQKFPLLLRARDAKRAATKLGIKRRTKEKAWCRCKLKKLYD

SEQ ID NO: 1170 - protein, 42 aa, Artificial Sequence
  Computer-generated peptide variant
KFRLLSKYIRLLKRWRLAGRHLWKLREAQASGYACARWKALE

SEQ ID NO: 1171 - protein, 78 aa, Artificial Sequence
  Computer-generated peptide variant
KFRIMPRFLKLLKKRKNAELKAANKALEQKKFKGALPAEAANNLHQARSWAALLTFYRVNAKLKDHRRRMRALSATAW

SEQ ID NO: 1172 - protein, 92 aa, Artificial Sequence
  Computer-generated peptide variant
RFRFIPRFMKRLSTTTELARHACKRLLTLQRLRNTRKLDLILLKLLARAHMMAARVPALRANAKQRILRQRNLASKKEKDLRNICFTHPKRI

SEQ ID NO: 1173 - protein, 75 aa, Artificial Sequence
  Computer-generated peptide variant
KFRFLRRMIKRMKKIYVGKDLKYTLLRWNRKEALIKERSAILPLKKNALAVKRRIYALLNARAILLMPFFLLGAK

SEQ ID NO: 1174 - protein, 20 aa, Artificial Sequence
  Computer-generated peptide variant
KLKFLNKLWRRIHQEREKAL

SEQ ID NO: 1175 - protein, 27 aa, Artificial Sequence
  Computer-generated peptide variant
RLRYLRKYFKILKSMNNQLKAGKLANV

SEQ ID NO: 1176 - protein, 60 aa, Artificial Sequence
  Computer-generated peptide variant
KLKIMCKLMRYFKKRTLTASKRHLRKAMRLIAEKCMKLSQKARMSIDKLLLRALAAAHMR

SEQ ID NO: 1177 - protein, 86 aa, Artificial Sequence
  Computer-generated peptide variant
YIRFLKRLLKRFSQMFTNLKLVRRFLLKRKADRALKLSCKRWIADHSRASLKCDRAASDALAYKAVKQRHRGFLRDQAPKGDHLRF

SEQ ID NO: 1178 - protein, 43 aa, Artificial Sequence
  Computer-generated peptide variant
RMRWFKRLLRYLPNASALLAIALKKQSRWLAKTDARMLQWVMK

SEQ ID NO: 1179 - protein, 48 aa, Artificial Sequence
  Computer-generated peptide variant
LWRLLRRLMKMLRQKARAYPAEAKISRNHKKLKKYVRARNAGEHAGRT

SEQ ID NO: 1180 - protein, 36 aa, Artificial Sequence
  Computer-generated peptide variant
RYRFWRRMYKWLRRQLALTRAASLANLAGGRELACF

SEQ ID NO: 1181 - protein, 20 aa, Artificial Sequence
  Computer-generated peptide variant
YIRFLNRFLKFLPCKKKQAA

SEQ ID NO: 1182 - protein, 49 aa, Artificial Sequence
  Computer-generated peptide variant
KYKFYQKLWKYIRCWDNAKRYDRSGRLRLLMAKASKAKLFAKAMACDFA

SEQ ID NO: 1183 - protein, 25 aa, Artificial Sequence
  Computer-generated peptide variant
YLKLLRRLLKRMTQHYTAMAKRCQN

SEQ ID NO: 1184 - protein, 53 aa, Artificial Sequence
  Computer-generated peptide variant
RFRLIKRLLKRFHRQDYIGLNYEESRYDSLAKWARLRRALTLRAMMQKLLLKP

SEQ ID NO: 1185 - protein, 63 aa, Artificial Sequence
  Computer-generated peptide variant
WFKLLKKLLKIYTRPKPTLLFPLALMSNSEALKVKQRKARYMLFMTLRRRKRLQRCRGHRVIA

SEQ ID NO: 1186 - protein, 21 aa, Artificial Sequence
  Computer-generated peptide variant
RIRLLKRLMRKMSPVKAEGLL

SEQ ID NO: 1187 - protein, 47 aa, Artificial Sequence
  Computer-generated peptide variant
LFRLIRKFLRRFRSRAAKQFLMMAHLRKAPEHWIRLKLNDKYARARR

SEQ ID NO: 1188 - protein, 22 aa, Artificial Sequence
  Computer-generated peptide variant
KLRLFPRLIRLFRKGARHKMAY

SEQ ID NO: 1189 - protein, 35 aa, Artificial Sequence
  Computer-generated peptide variant
RLRLYKKLFRFLRRRKLIDRSAFGRTNSLLCAMFL

SEQ ID NO: 1190 - protein, 30 aa, Artificial Sequence
  Computer-generated peptide variant
RLRYWPKLLKMLKKNGKVVWQRNLKTAASL

SEQ ID NO: 1191 - protein, 29 aa, Artificial Sequence
  Computer-generated peptide variant
ILRLLSRFWKWLKKKLAAKDQLAFERLCK

SEQ ID NO: 1192 - protein, 39 aa, Artificial Sequence
  Computer-generated peptide variant
KLKWMRRLYKWLPTKAEAKRLLTAICLNDRRARQGARDL

SEQ ID NO: 1193 - protein, 23 aa, Artificial Sequence
  Computer-generated peptide variant
LLKFYSKFLRRFRRAFGTKWSLA

SEQ ID NO: 1194 - protein, 24 aa, Artificial Sequence
  Computer-generated peptide variant
LMRLIRKLWKFFTCRFHLIKRRAL

SEQ ID NO: 1195 - protein, 42 aa, Artificial Sequence
  Computer-generated peptide variant
KYKWYTRWYRFMHKHIKRLSRWAALQKIACKPARALLTLKRK

SEQ ID NO: 1196 - protein, 26 aa, Artificial Sequence
  Computer-generated peptide variant
YIKLLRKLMRLFKQLKSSLCLADYRE

SEQ ID NO: 1197 - protein, 45 aa, Artificial Sequence
  Computer-generated peptide variant
RLRFFTRLFKRFHCNFLALKRKREAEKHLRADQNKRREAMAHQLR

SEQ ID NO: 1198 - protein, 43 aa, Artificial Sequence
  Computer-generated peptide variant
LLKLISKLFKKLHRKRVQLLKAAKRLPAMFYKYKVIARQKIVA

SEQ ID NO: 1199 - protein, 20 aa, Artificial Sequence
  Computer-generated peptide variant
RIKWLNRLLRKMCHSRHLLN

SEQ ID NO: 1200 - protein, 60 aa, Artificial Sequence
  Computer-generated peptide variant
LFKILKRLIRLLNCKAAKRHPKLLLKPLRRCAWNEMQKKEAYIREEFLPYATKRARTKVC

SEQ ID NO: 1201 - protein, 35 aa, Artificial Sequence
  Computer-generated peptide variant
WLKLLPRLIRLMCRALKKRCMMWLLAFTQRRMHAN

SEQ ID NO: 1202 - protein, 27 aa, Artificial Sequence
  Computer-generated peptide variant
YWKLLKRLLKRMPKAPYACAHKIHMAD

SEQ ID NO: 1203 - protein, 24 aa, Artificial Sequence
  Computer-generated peptide variant
KWRLLQRFFKLLKHSKRHAKAALL

SEQ ID NO: 1204 - protein, 53 aa, Artificial Sequence
  Computer-generated peptide variant
KFRLLSRLFRLLRRAIQWLMHEVDPAANSLRLALVKAKRFRKKAELVKACLKM

SEQ ID NO: 1205 - protein, 66 aa, Artificial Sequence
  Computer-generated peptide variant
KIKLLPRLIRMLRKDPFKLMPRKFMRWTKRDVLWVDSWAKRQFSKLKRLRAVKEKRLLRALPILQA

SEQ ID NO: 1206 - protein, 79 aa, Artificial Sequence
  Computer-generated peptide variant
RLRWLKRYIKIFNRRLKLAKKLAIRRSPAVALARPAMWFHLGGDARRQTTKPLLGYNDKKYCKVYSLKWYLAEIAKRKK

SEQ ID NO: 1207 - protein, 20 aa, Artificial Sequence
  Computer-generated peptide variant
RFRLLCRFWKLMKRILKSLA

SEQ ID NO: 1208 - protein, 30 aa, Artificial Sequence
  Computer-generated peptide variant
KLKFLCKFLRKWKRYRGPFLLHRPLLSIKC

SEQ ID NO: 1209 - protein, 21 aa, Artificial Sequence
  Computer-generated peptide variant
LMKYIRKWLRKLQKERLCLVD

SEQ ID NO: 1210 - protein, 37 aa, Artificial Sequence
  Computer-generated peptide variant
LLKMMKKLLRWIRSRFKRLLRPQWKRRIGEALFATDH

SEQ ID NO: 1211 - protein, 99 aa, Artificial Sequence
  Computer-generated peptide variant
LFRYWKKLFRRIRKKRCLARALLSKSKLNAKCIKTALLHRLKLGLAAKYLALHALNRAIYCRSRLQPATNKKFAPVIFRMFLEHHLHKMKRKFTYSRNN

SEQ ID NO: 1212 - protein, 36 aa, Artificial Sequence
  Computer-generated peptide variant
MMRYWKKLWKRFRCAMLDLKAVKRLLADKQVHATAC

SEQ ID NO: 1213 - protein, 86 aa, Artificial Sequence
  Computer-generated peptide variant
RLKLYNRILKFLKSLHLLHAECASKRYLWNRLKKFKTRKKPCPKKGKAWNDGWIKKAMAIVKLARNPLLRRVRGAALLKAPKRHEF

SEQ ID NO: 1214 - protein, 39 aa, Artificial Sequence
  Computer-generated peptide variant
IYRLIKRMWKRLRKKAMRLRIPFDRSAAEDILKLRAIFA

SEQ ID NO: 1215 - protein, 83 aa, Artificial Sequence
  Computer-generated peptide variant
YLKLWKKMLRFIQPRTLEALALFSKWMVSAISKLRAKEKKGWAWMRIRIAAKLMRFFIAHEKKMNRAKAQSARLIARYYKKLA

SEQ ID NO: 1216 - protein, 82 aa, Artificial Sequence
  Computer-generated peptide variant
FYRFLRKLFRILKRIQVKWIRKKMRRTALYRTQFKKKMLTTPFRALYYGILLRPKAKAKLLLASQTELYFLKLHFSLRLRKG

SEQ ID NO: 1217 - protein, 51 aa, Artificial Sequence
  Computer-generated peptide variant
YLRLYKRWLRFFCNKLYTLRLNNRKEMQRARLSIAKCMNKVKKKRLAVKCA

SEQ ID NO: 1218 - protein, 40 aa, Artificial Sequence
  Computer-generated peptide variant
MMRFLSRYLRMMQHKNRKLRKKALLIHDKRAHLDKSHKLP

SEQ ID NO: 1219 - protein, 69 aa, Artificial Sequence
  Computer-generated peptide variant
LLKLLPRIMKKMRPLILWRKREKMGHDWLHFLWAPISPKEALNARVKGKLKDRAKCDNMWRKLAKLGRR

SEQ ID NO: 1220 - protein, 92 aa, Artificial Sequence
  Computer-generated peptide variant
RMKFFCKLLKMLKQIRRKLKRARSRFNSKRQYEYAAAMKNKRKYAWAAAGPALSLKKILGRHAWKKKNWRWKTQAMFLKRHQLRLGLCRKAI

SEQ ID NO: 1221 - protein, 23 aa, Artificial Sequence
  Computer-generated peptide variant
KYKLYKKIMRKLRHLAAQTDHLT

SEQ ID NO: 1222 - protein, 91 aa, Artificial Sequence
  Computer-generated peptide variant
KYKMLHRLLRRYKTKMCRLNLLRHRSLNHARLANRNLSLWRKLSALFRTLLLAKKAAEMPNANFPDCIIDARVIKKRAPYKKYPAKIRRLE

SEQ ID NO: 1223 - protein, 46 aa, Artificial Sequence
  Computer-generated peptide variant
LMRLFKRYFKRWKPWYFQLREVTLKKANKKVAKAAAKATEELRADK

SEQ ID NO: 1224 - protein, 20 aa, Artificial Sequence
  Computer-generated peptide variant
RLRYLRRFWKYMHKRALSLL

SEQ ID NO: 1225 - protein, 65 aa, Artificial Sequence
  Computer-generated peptide variant
KLKILQRLFRYWPRARFREKNSFLVTKCHQATRLYALARRNGHFNAKIEKANLGAKLALAELKLR

SEQ ID NO: 1226 - protein, 38 aa, Artificial Sequence
  Computer-generated peptide variant
FIKYMKKLLRWYRKAWIARFQHLRDAEYKLAKNYRLLD

SEQ ID NO: 1227 - protein, 30 aa, Artificial Sequence
  Computer-generated peptide variant
RFKILCKLIKLINKFKKEALPARATFQHKA

SEQ ID NO: 1228 - protein, 34 aa, Artificial Sequence
  Computer-generated peptide variant
WLRWLRRLIRKIHHELLDRAKRPSIFLAKALAKY

SEQ ID NO: 1229 - protein, 46 aa, Artificial Sequence
  Computer-generated peptide variant
MYKIWNRWLRLWKNLGLRRFAKALIHHARARDAKRKDLAGGLWAWE

SEQ ID NO: 1230 - protein, 35 aa, Artificial Sequence
  Computer-generated peptide variant
LFRILPKMLRRLCHFVFKLAMKARAMKAAGRPHQK

SEQ ID NO: 1231 - protein, 29 aa, Artificial Sequence
  Computer-generated peptide variant
RMKYWSKFLRWLTKPKARARDKEKLLFAA

SEQ ID NO: 1232 - protein, 49 aa, Artificial Sequence
  Computer-generated peptide variant
LFRFIRKWWKKFNKAMAWSRPLKAILHLKCNRQRADALAVKARVWKHQL

SEQ ID NO: 1233 - protein, 36 aa, Artificial Sequence
  Computer-generated peptide variant
LFRIIKKMLRKMTKPLKSFAEKNAKLRNLLRLRAYL

SEQ ID NO: 1234 - protein, 70 aa, Artificial Sequence
  Computer-generated peptide variant
FLRLLQKYFRRLCRRRPYHDKARMIKLSEFKAHQASARRSLWGKCAATRQARRKLTVRGAPRKSMWAQKK

SEQ ID NO: 1235 - protein, 72 aa, Artificial Sequence
  Computer-generated peptide variant
RLRILKRFLRRYKSRKNLAASTLLNRIPNLGLKAMAIQKNLMLARVAYGNPLALAWGCTGAFLKLKKQSCRW

SEQ ID NO: 1236 - protein, 87 aa, Artificial Sequence
  Computer-generated peptide variant
IFKLFRRLFKRLPKRRKELLRVLMPGQKSKTAAKRKLPRGTIAVLKRMNWACWTSLPWARTRSRRCQLLRKCSKLKSKGAAAVPFLC

SEQ ID NO: 1237 - protein, 20 aa, Artificial Sequence
  Computer-generated peptide variant
RLRLWKKYLRLLCKLGMRCQ

SEQ ID NO: 1238 - protein, 58 aa, Artificial Sequence
  Computer-generated peptide variant
RYKFLHKLYRFLHKPEDQRLRGAIHWWATCLKALNRRLLQQGKFKAYALADKQLLRRT

SEQ ID NO: 1239 - protein, 72 aa, Artificial Sequence
  Computer-generated peptide variant
RFKMLRRLFRRMKRKLITYKNAISGKTHQPLLRKRANTKIMLYKHKAFQKGRKGSEAKLLNAACWKALFARH

SEQ ID NO: 1240 - protein, 20 aa, Artificial Sequence
  Computer-generated peptide variant
RWKLYRRLFRLISHAGALCC

SEQ ID NO: 1241 - protein, 47 aa, Artificial Sequence
  Computer-generated peptide variant
LLKLMPKILRRFKSEYALLFMAIAIIKRILRIKKNHLLIAISRATWR

SEQ ID NO: 1242 - protein, 63 aa, Artificial Sequence
  Computer-generated peptide variant
FYKLWSKFWKKLKSRLAEKRWRDVLLAYVRRRMKAGKQAARDIANLALAFARKWADTRDNLLA

SEQ ID NO: 1243 - protein, 30 aa, Artificial Sequence
  Computer-generated peptide variant
KLKWLNRFLRKLCRWLKRLHKKRARHLLAY

SEQ ID NO: 1244 - protein, 20 aa, Artificial Sequence
  Computer-generated peptide variant
LLRWLRKMLRKWKNELKWLA

SEQ ID NO: 1245 - protein, 30 aa, Artificial Sequence
  Computer-generated peptide variant
FWRLIRKLLKRLHKQTKLKRSQAYAFRWWT

SEQ ID NO: 1246 - protein, 38 aa, Artificial Sequence
  Computer-generated peptide variant
RLKLWRRLLRKLKQAATRLWNARRFNLDLKWRVYRLRK

SEQ ID NO: 1247 - protein, 94 aa, Artificial Sequence
  Computer-generated peptide variant
KLRLYSRFFRFLKCAELCRFLAKRKKAQQARKSKRRVFQRRCSYSAKPRRLWSPALALNLLRCPCRKILSSLKKEGLRKRKLDQGKDWEQMLRE

SEQ ID NO: 1248 - protein, 21 aa, Artificial Sequence
  Computer-generated peptide variant
KYRLLKKILRLLRKDQFALNK

SEQ ID NO: 1249 - protein, 23 aa, Artificial Sequence
  Computer-generated peptide variant
RFKLFRRFLRLFTKENMAAVLNK

SEQ ID NO: 1250 - protein, 49 aa, Artificial Sequence
  Computer-generated peptide variant
LLKLLKKFIRLFCRMEVKLKWTRGLVEGAAAAKRDLVWNALRRAVKACH

SEQ ID NO: 1251 - protein, 29 aa, Artificial Sequence
  Computer-generated peptide variant
MLKLFRKWYRKFKPAALSCARFNLKSMFA

SEQ ID NO: 1252 - protein, 28 aa, Artificial Sequence
  Computer-generated peptide variant
KLRLLSKMLKKYPKLSKKVQLLMLLKWW

SEQ ID NO: 1253 - protein, 52 aa, Artificial Sequence
  Computer-generated peptide variant
KMRLMNRFYRKFKKVKLYQDRAEKRLAHTRPNAPQAKMKIVHAAAAPRKAKQ

SEQ ID NO: 1254 - protein, 28 aa, Artificial Sequence
  Computer-generated peptide variant
LFKLFNKWWRILCQLQMDAARAKRLFKK

SEQ ID NO: 1255 - protein, 36 aa, Artificial Sequence
  Computer-generated peptide variant
KLKIYQKLFKFLQHEARKRIAYLFACMCAITKRALK

SEQ ID NO: 1256 - protein, 44 aa, Artificial Sequence
  Computer-generated peptide variant
FYKLLRKFFRKWRKRHNGRMADANALVWRLALKHRVAKNMKHSA

SEQ ID NO: 1257 - protein, 40 aa, Artificial Sequence
  Computer-generated peptide variant
LLKFFTRWLKLMRRQFLRARVTDIGAAKIVRAAKTYYRNA

SEQ ID NO: 1258 - protein, 55 aa, Artificial Sequence
  Computer-generated peptide variant
LLRLLCKLYRYWSTLRSRKAAEMDLCALLLRLHMVHLRDASRERRLRQHAMLEKK

SEQ ID NO: 1259 - protein, 41 aa, Artificial Sequence
  Computer-generated peptide variant
IMRLLTKWLKKIKRACQFKKALLIRNAKNWRSLLCAQLLLY

SEQ ID NO: 1260 - protein, 72 aa, Artificial Sequence
  Computer-generated peptide variant
RLKILPKFIRKLCRTCEIKRAWLKLHLAAKKRFKPAKHCMSKTPQTAAARHALRLHKQAFERCRPLTSYALQ

SEQ ID NO: 1261 - protein, 37 aa, Artificial Sequence
  Computer-generated peptide variant
RLRLLRRFWKRYRHGLMALLALPKGMRKPAARDGLDE

SEQ ID NO: 1262 - protein, 88 aa, Artificial Sequence
  Computer-generated peptide variant
LLRLFKKMFKFISRVRLGDLQRYYSRCARVVEAKAQALKYLVAYKYPFPSARRQDNKRRWAKLQCARSMAKGALRRKDLLRKDKMKIR

SEQ ID NO: 1263 - protein, 71 aa, Artificial Sequence
  Computer-generated peptide variant
RWKLFTKFLKKMKRRLDLKAHDKKLLWALAANLGKPHKKALWLIDEAIDRLRYMLALINAVLQACRGWHAW

SEQ ID NO: 1264 - protein, 98 aa, Artificial Sequence
  Computer-generated peptide variant
RLKFFCRLLKLLQCQKRIKRVGFLLEKFVRQKIKLVGGYLALRKRHRAKLRSSAEFNSVLAKFLAPIKLNSTKHAHAVRARDGRKQLLLKRPRHKIAA

SEQ ID NO: 1265 - protein, 74 aa, Artificial Sequence
  Computer-generated peptide variant
RYRLFRRLLRRWQQTLKKEKGLYQLRLQAAFKPPQRCRWARHTLKEKALRLAFHNRLHGHTMKSWCAAALKHLE

SEQ ID NO: 1266 - protein, 61 aa, Artificial Sequence
  Computer-generated peptide variant
RMRYFRKLLKKITCWAHQALVSLADRKHNEAAQPLRRKLYLKVAVSRFAWERLNLFALLRD

SEQ ID NO: 1267 - protein, 25 aa, Artificial Sequence
  Computer-generated peptide variant
LMRFYQRFLRFLKHALFKDSALADR

SEQ ID NO: 1268 - protein, 50 aa, Artificial Sequence
  Computer-generated peptide variant
KFKFIRRLFRWWRNCSRWPKELRLHAWLACDLKAAKLRLADKNKDLGLNR

SEQ ID NO: 1269 - protein, 23 aa, Artificial Sequence
  Computer-generated peptide variant
RLRLFKRLLRLMTSKLLNATYSY

SEQ ID NO: 1270 - protein, 44 aa, Artificial Sequence
  Computer-generated peptide variant
RMRYFRKFLRMFRCRVAFLAAQCRLAKYRRQKERKAYCLKLEAT

SEQ ID NO: 1271 - protein, 33 aa, Artificial Sequence
  Computer-generated peptide variant
RLRLICKYLKLLRKHCLVKLKITFAKSNRKPLK

SEQ ID NO: 1272 - protein, 38 aa, Artificial Sequence
  Computer-generated peptide variant
RYKMIRKLLKRFPRWFRLSKSKDMETVASLHLLAKKGL

SEQ ID NO: 1273 - protein, 96 aa, Artificial Sequence
  Computer-generated peptide variant
KLKLMPKWWKILKRYVRMNALAYYRLDRKNDAAWEWAAFARIAQLKRKTWLRRIGKMRKALTKKAIFRRALMRKYKLTHSQKTHPAIKMWREEKAV

SEQ ID NO: 1274 - protein, 25 aa, Artificial Sequence
  Computer-generated peptide variant
FWKWFHKLIKLLKKCNLHCYRKLLL

SEQ ID NO: 1275 - protein, 22 aa, Artificial Sequence
  Computer-generated peptide variant
LLKWLHKYFRKFKHSLYALQKK

SEQ ID NO: 1276 - protein, 58 aa, Artificial Sequence
  Computer-generated peptide variant
KMKMIKKYWKRYKKLRIAILERVREAKRRDLSVAVVGGKHLAPPRWLARSALRFLAAL

SEQ ID NO: 1277 - protein, 56 aa, Artificial Sequence
  Computer-generated peptide variant
MYRIFSRMFRWLTPKTKKCALACALKRKKLALCWGRNKLVRDHRLARGYLWWKRRY

SEQ ID NO: 1278 - protein, 47 aa, Artificial Sequence
  Computer-generated peptide variant
KWKYLRKLLRLFKRHLLLSYAQKHAKCINTGRKGRKKNICLAMHARR

SEQ ID NO: 1279 - protein, 33 aa, Artificial Sequence
  Computer-generated peptide variant
RWKLLRKLLKRLKNRGQRLAKLTNMNNLWYTKT

SEQ ID NO: 1280 - protein, 40 aa, Artificial Sequence
  Computer-generated peptide variant
KYKLFKKLFKWWCKLTILDDLAERALCNAHLMLPRHRDRK

SEQ ID NO: 1281 - protein, 75 aa, Artificial Sequence
  Computer-generated peptide variant
YYKWLSKYMKRLKKCCHQTPARYTIAKLRHLMIKLDMPAALKLLDPNRRIARRTAQMRRRLRAAHAQLHKARNLA

SEQ ID NO: 1282 - protein, 74 aa, Artificial Sequence
  Computer-generated peptide variant
KFKLLPKLMKKLRSLSPSRALIRLYMDFHNQLAKRARARLAGGLKVYKRPKLREIRAKVGLDLRYHVAWPLFDL

SEQ ID NO: 1283 - protein, 38 aa, Artificial Sequence
  Computer-generated peptide variant
RWKMLRRWLKKMNKRKHSCWLVMADRALALIRCELADC

SEQ ID NO: 1284 - protein, 30 aa, Artificial Sequence
  Computer-generated peptide variant
FLRFLHKLWKKIRRLARLTCLIQPKFCKVK

SEQ ID NO: 1285 - protein, 51 aa, Artificial Sequence
  Computer-generated peptide variant
RLRYIRRLWRRIRHLKLNMALYCFRRLRELRAWHMAACLNKMTKRALAASR

SEQ ID NO: 1286 - protein, 51 aa, Artificial Sequence
  Computer-generated peptide variant
RLKYFTKWFRKLKRYWKVKCKERKLCKFGTLNLRALELLALLLLFCLLGNR

SEQ ID NO: 1287 - protein, 30 aa, Artificial Sequence
  Computer-generated peptide variant
KFRLIKRLMRKLKSVTKAEALKFHRQLAGC

SEQ ID NO: 1288 - protein, 37 aa, Artificial Sequence
  Computer-generated peptide variant
LFKIYKRFYKKMRKRLSARLGLANAFVKRALTLVVSE

SEQ ID NO: 1289 - protein, 47 aa, Artificial Sequence
  Computer-generated peptide variant
WWRFYPKLLKRLRKATHKIKGCALWPAAKDRAQMARAHGAGRRLALW

SEQ ID NO: 1290 - protein, 38 aa, Artificial Sequence
  Computer-generated peptide variant
LFRLMQKLMKRIQKACLLRLKWAMLKAVRLEFWRYVNM

SEQ ID NO: 1291 - protein, 38 aa, Artificial Sequence
  Computer-generated peptide variant
FLRFLKRLIKRFPKARDGMLRVQKTHAYFATAYAALWL

SEQ ID NO: 1292 - protein, 24 aa, Artificial Sequence
  Computer-generated peptide variant
RMRLYPRLLRMYRRQMRAYLRANW

SEQ ID NO: 1293 - protein, 38 aa, Artificial Sequence
  Computer-generated peptide variant
LYKWWRKLWKFFKRGLRKIAGLTTPKKARAILRTFANA

SEQ ID NO: 1294 - protein, 34 aa, Artificial Sequence
  Computer-generated peptide variant
FLRLLQKLLRRYSKLKFCYLRESGCAIAARTWRM

SEQ ID NO: 1295 - protein, 38 aa, Artificial Sequence
  Computer-generated peptide variant
LIKLFKKLLKLLKHKWRQAAAFRTHAKAVAATEWIWFR

SEQ ID NO: 1296 - protein, 40 aa, Artificial Sequence
  Computer-generated peptide variant
RWKLFRKFLRKIKPIRDPAADHDQVAAGTKLQAFRLLLAC

SEQ ID NO: 1297 - protein, 61 aa, Artificial Sequence
  Computer-generated peptide variant
RWKLMKRLYRLFRKNTLRLGLGVLREKLFALREKNKTRNGCRRSLMHNLAWGQRYLRKATR

SEQ ID NO: 1298 - protein, 34 aa, Artificial Sequence
  Computer-generated peptide variant
RLKFLCRFYRKYPRHLTQCDSKAKRALARAYDLP

SEQ ID NO: 1299 - protein, 36 aa, Artificial Sequence
  Computer-generated peptide variant
KWRLLRRLLKFFNRKLAQRLRQLAAGCRQLCRRMVT

SEQ ID NO: 1300 - protein, 28 aa, Artificial Sequence
  Computer-generated peptide variant
LLKILRRWFRLWRHLTALARKDTLAKPP

SEQ ID NO: 1301 - protein, 21 aa, Artificial Sequence
  Computer-generated peptide variant
MLRLLQKMFRRLHTDRLEAKQ

SEQ ID NO: 1302 - protein, 59 aa, Artificial Sequence
  Computer-generated peptide variant
YMRILKRWWRLWRCLKKHRLAACCMLTRLLLNLKMKEVMGECQKLKKTGKLKELAEKER

SEQ ID NO: 1303 - protein, 42 aa, Artificial Sequence
  Computer-generated peptide variant
RMRLINRWIKILHKRRRNLLAGKLIWVLRIDLVCARNLAKWL

SEQ ID NO: 1304 - protein, 27 aa, Artificial Sequence
  Computer-generated peptide variant
KLKWLSKLIRKLPKKWIKAKCAAYCIF

SEQ ID NO: 1305 - protein, 46 aa, Artificial Sequence
  Computer-generated peptide variant
KYRIFKKLFKRWRRARWDMRPFTRQILLLLGPFRRQITAEKLRAAL

SEQ ID NO: 1306 - protein, 42 aa, Artificial Sequence
  Computer-generated peptide variant
KMRMLTKYIRKWKRLLHHRIKHKGLRLCECWALRALADAPRR

SEQ ID NO: 1307 - protein, 85 aa, Artificial Sequence
  Computer-generated peptide variant
RLKFLRKMFKRIQPEKALQKTWAKKAAVLRWTRAKDAPRALGITKLQWAYLARPVKHKWRFLATCRCALRINKLVPDKRRNALVR

SEQ ID NO: 1308 - protein, 23 aa, Artificial Sequence
  Computer-generated peptide variant
RFKLYTKLYRRMTKSALAQLQPR

SEQ ID NO: 1309 - protein, 46 aa, Artificial Sequence
  Computer-generated peptide variant
MFKMLKRFLRKYKNKSIKRTDKIVLAILATIAFVKLLAKAKLAAGW

SEQ ID NO: 1310 - protein, 41 aa, Artificial Sequence
  Computer-generated peptide variant
KLKMFCRLLRRWKCRRACKCIRRKNSARSWHKALALKLPLA

SEQ ID NO: 1311 - protein, 31 aa, Artificial Sequence
  Computer-generated peptide variant
WMRLMCKLLRMIKRKNQKTLFLRMPLLRRKA

SEQ ID NO: 1312 - protein, 23 aa, Artificial Sequence
  Computer-generated peptide variant
LLKWLKRYIRKLKKHMAASRKLM

SEQ ID NO: 1313 - protein, 27 aa, Artificial Sequence
  Computer-generated peptide variant
KLRLMRKLFRFIHKKRLDWKRNALLLY

SEQ ID NO: 1314 - protein, 27 aa, Artificial Sequence
  Computer-generated peptide variant
KFKLMKRWLKLLKSDFPRPSAAALINK

SEQ ID NO: 1315 - protein, 25 aa, Artificial Sequence
  Computer-generated peptide variant
LMKLFRKMLKLFRHRAHTLLIMNRD

SEQ ID NO: 1316 - protein, 40 aa, Artificial Sequence
  Computer-generated peptide variant
RFKILKRIMRFFKKKPKCLAHLQRAAKLASFQWARNLKAC

SEQ ID NO: 1317 - protein, 36 aa, Artificial Sequence
  Computer-generated peptide variant
LLKLMKRFFKKLRNASVYMRAHMIYMAARLKRAYWY

SEQ ID NO: 1318 - protein, 73 aa, Artificial Sequence
  Computer-generated peptide variant
MWRLLCRYFRKLRRRPLAGLDRLFLKKPGSMIAHASHAAKGNGKKRLRCRFLRHPYRCKKRLLAATLLVSAYH

SEQ ID NO: 1319 - protein, 27 aa, Artificial Sequence
  Computer-generated peptide variant
LMKLIKRFLRRWHRVAIRHRIERWAAA

SEQ ID NO: 1320 - protein, 42 aa, Artificial Sequence
  Computer-generated peptide variant
RWKFLRKYLRILRRGTAYAKLRIADAHLLQGLRFRLYRLHTL

SEQ ID NO: 1321 - protein, 40 aa, Artificial Sequence
  Computer-generated peptide variant
WMKLLRRLMRRLTPRVRWKDLARLRMLLIKERMNQVVALW

SEQ ID NO: 1322 - protein, 31 aa, Artificial Sequence
  Computer-generated peptide variant
RLRWLKRFWRRICRLALMLIRHDRNVGAKGL

SEQ ID NO: 1323 - protein, 74 aa, Artificial Sequence
  Computer-generated peptide variant
RYKWFKRYLKKWKRAELPLLYSARAKRNYVAPLKCVQGYRLLIAKVAERQWRSKLNAGHKRAPIPDLAELRLAA

SEQ ID NO: 1324 - protein, 36 aa, Artificial Sequence
  Computer-generated peptide variant
LLKLLRRFFKIMKKYCVLNDRKWHARVLKILVPLWA

SEQ ID NO: 1325 - protein, 44 aa, Artificial Sequence
  Computer-generated peptide variant
LYRWFKRFFKLMSRAFRLKKALARQSCKSKAVPQALGLAAHFLE

SEQ ID NO: 1326 - protein, 75 aa, Artificial Sequence
  Computer-generated peptide variant
KYKWFKKLWRWLRHSPPLYCRAKCKFKERLVKKADRLLILACTALDKRLRAVFAEIFIFMTKHLLECKLIKALAR

SEQ ID NO: 1327 - protein, 70 aa, Artificial Sequence
  Computer-generated peptide variant
KLRFYHKLLKIYKNRIARAAQAQRKYRLLQEGADMDKIRGVLLQLLLAPSNWKLRKRLVLVAKTKKDHWA

SEQ ID NO: 1328 - protein, 29 aa, Artificial Sequence
  Computer-generated peptide variant
LFKIFKRLLKRLRRSCDAMGFMRIREAAN

SEQ ID NO: 1329 - protein, 34 aa, Artificial Sequence
  Computer-generated peptide variant
KLRMLQRYYKFFHRNRVPARPYLRDAAHARLKQR

SEQ ID NO: 1330 - protein, 49 aa, Artificial Sequence
  Computer-generated peptide variant
KLKYLRRWFKKLKPPLLLYRTRLKFRATAMGFCAKKGAPNITRAWESKM

SEQ ID NO: 1331 - protein, 60 aa, Artificial Sequence
  Computer-generated peptide variant
LFKIWNRMFKKLHKMADHIERKKKKRTRRNTKAYYNLKLLRDAKLAERHVLKNAEPLYAY

SEQ ID NO: 1332 - protein, 21 aa, Artificial Sequence
  Computer-generated peptide variant
KFRILHKLYKKLHTFVAKLAH

SEQ ID NO: 1333 - protein, 55 aa, Artificial Sequence
  Computer-generated peptide variant
KMRLLKKFFKLLKTRIMRLRNMKLQLAKKKFQIKARLLLESMHLVADNANLRYVT

SEQ ID NO: 1334 - protein, 34 aa, Artificial Sequence
  Computer-generated peptide variant
KLRLMKRLLKKMQRWALADPRSLGAARTKWNSRK

SEQ ID NO: 1335 - protein, 22 aa, Artificial Sequence
  Computer-generated peptide variant
KIKLLCRIYRKWKKRALVTAIA

SEQ ID NO: 1336 - protein, 41 aa, Artificial Sequence
  Computer-generated peptide variant
YWKLLQRFIKRFRREIVLKGNGLKNKKLIKLALSTQLHLRK

SEQ ID NO: 1337 - protein, 40 aa, Artificial Sequence
  Computer-generated peptide variant
RLRWLKRWLRRYRCEGYRATSKGIHFLKKLAWMKLAQTLC

SEQ ID NO: 1338 - protein, 59 aa, Artificial Sequence
  Computer-generated peptide variant
LLKLFRKFLKRIRKKYQCTAAALALDKWAISGPKAFHKKRKVSLTCLGKHMRLGAKEWL

SEQ ID NO: 1339 - protein, 30 aa, Artificial Sequence
  Computer-generated peptide variant
ILKFLTRIWRLMKKAKARAARMLDRDATQV

SEQ ID NO: 1340 - protein, 50 aa, Artificial Sequence
  Computer-generated peptide variant
LLRFWRRLMRWYQRAKMAKRCRYQQLVALKNLFQLRAKRNAMIRCRALMI

SEQ ID NO: 1341 - protein, 74 aa, Artificial Sequence
  Computer-generated peptide variant
RMRLFNKLMKFLRKKGMYRLAPHGKAYPNLRLRLYRRIKKARRKASRYKQIKYDTLLYFLDWPGNGARYAEAKR

SEQ ID NO: 1342 - protein, 70 aa, Artificial Sequence
  Computer-generated peptide variant
KIKLLKRLMRRYPKLRTECWPAHRKKAAESKCLHLLYLAQKGNSNKAFAWRLKFPAKWARDRHGHALARQ

SEQ ID NO: 1343 - protein, 72 aa, Artificial Sequence
  Computer-generated peptide variant
ILKMLRRWFKFLKRRQFSLFCRLACYTKLHICRRLRKETIMEKAFRACMGLKLPQSLHLDAPKALKAKAIKK

SEQ ID NO: 1344 - protein, 25 aa, Artificial Sequence
  Computer-generated peptide variant
KMRYFCKLLKLFNRRVARQARVHSL

SEQ ID NO: 1345 - protein, 37 aa, Artificial Sequence
  Computer-generated peptide variant
FLRLIKRWFKRFRNVKCHAFLAARKIHNWLRLKLALS

SEQ ID NO: 1346 - protein, 28 aa, Artificial Sequence
  Computer-generated peptide variant
YFKWMKRFIRWMKKNLALTANDLLLLRR

SEQ ID NO: 1347 - protein, 31 aa, Artificial Sequence
  Computer-generated peptide variant
KLKFFNKMIKRLNKPWRQLRACIAKIARAAQ

SEQ ID NO: 1348 - protein, 21 aa, Artificial Sequence
  Computer-generated peptide variant
KLKLLRKLLKKIQTSYCAECC

SEQ ID NO: 1349 - protein, 20 aa, Artificial Sequence
  Computer-generated peptide variant
WLKILSKLYKLWCCLALHRK

SEQ ID NO: 1350 - protein, 20 aa, Artificial Sequence
  Computer-generated peptide variant
IYKLICRLLRRFKHNALNLA

SEQ ID NO: 1351 - protein, 83 aa, Artificial Sequence
  Computer-generated peptide variant
RFRILKRLYKWIRCLIALWILRAVKAKAAAVKPQCLAHAANGWRSKMDACGQAWLQRLKKMTKNKCAWLRMKRRKLRNQKKKD

SEQ ID NO: 1352 - protein, 26 aa, Artificial Sequence
  Computer-generated peptide variant
RWRLLNKLMRIWRKACRAKAPHLYWI

SEQ ID NO: 1353 - protein, 50 aa, Artificial Sequence
  Computer-generated peptide variant
LLRYYRKWMRKFRTACAALANKIYKFLTCDAGKAKIAQKMHMKKRACRLS

SEQ ID NO: 1354 - protein, 28 aa, Artificial Sequence
  Computer-generated peptide variant
RYRFYKKFFKRLTRWEAFAQRALCNALR

SEQ ID NO: 1355 - protein, 31 aa, Artificial Sequence
  Computer-generated peptide variant
LFRYLRKFLKWFRKVKELARCKLLREAPPGD

SEQ ID NO: 1356 - protein, 28 aa, Artificial Sequence
  Computer-generated peptide variant
KLRLFNKMLKLMCKARLNYMKGCIREAK

SEQ ID NO: 1357 - protein, 28 aa, Artificial Sequence
  Computer-generated peptide variant
LYRLLKRIMKYLPRQKEALRTVNWKKLQ

SEQ ID NO: 1358 - protein, 60 aa, Artificial Sequence
  Computer-generated peptide variant
FWRYYRRWLRIFKKYTHRKTLRRMCNALNKKRVAKLKLAASFSTKDDLRALPRRVLTGLK

SEQ ID NO: 1359 - protein, 28 aa, Artificial Sequence
  Computer-generated peptide variant
RIKILTRLLKMLRKNLRLLLKPKLSKLF

SEQ ID NO: 1360 - protein, 32 aa, Artificial Sequence
  Computer-generated peptide variant
LMKWLHKLLRLFKPKFVRKMRNAAVWKHLLMY

SEQ ID NO: 1361 - protein, 29 aa, Artificial Sequence
  Computer-generated peptide variant
RLRILTRLLRILTRAAEMCRKLGQHLKRW

SEQ ID NO: 1362 - protein, 63 aa, Artificial Sequence
  Computer-generated peptide variant
KLRLLPKWWRRFKRLSRLIILPPWLWMGADRLRASEMLLLVPRRQIKNSPKKARTAKFRRRVD

SEQ ID NO: 1363 - protein, 34 aa, Artificial Sequence
  Computer-generated peptide variant
LYRLFQRWFRLFTKAIKVALFEHRIRLWKAKKLS

SEQ ID NO: 1364 - protein, 40 aa, Artificial Sequence
  Computer-generated peptide variant
KMKFYRRYFRLLCQRRQAVFRILLKLKHARCHKQLCLKWF

SEQ ID NO: 1365 - protein, 58 aa, Artificial Sequence
  Computer-generated peptide variant
ILRWLQKYWRKFRRKIMYGLINKSALCAIKKARAFDNVELAAAHKKKAKALLSSNMRA

SEQ ID NO: 1366 - protein, 40 aa, Artificial Sequence
  Computer-generated peptide variant
RMRLLRKFYKLFKKLVERADAKISYKMFRLVRLQAGWKGM

SEQ ID NO: 1367 - protein, 27 aa, Artificial Sequence
  Computer-generated peptide variant
RYKLLQRFMKRMRKRALLLQKVIARAL

SEQ ID NO: 1368 - protein, 34 aa, Artificial Sequence
  Computer-generated peptide variant
RLKLFNRFMRRYKRNACAYCYRKLDDLAEQRAWA

SEQ ID NO: 1369 - protein, 30 aa, Artificial Sequence
  Computer-generated peptide variant
LIKMLKRFFKFWKRPMGCWLAQRLLKKRFL

SEQ ID NO: 1370 - protein, 32 aa, Artificial Sequence
  Computer-generated peptide variant
WLKFLSRLLRRWPCELAFKVPKLQRCSQLKKA

SEQ ID NO: 1371 - protein, 30 aa, Artificial Sequence
  Computer-generated peptide variant
YFRLFRKYLRLFQQAENRPLRRSRKLDALF

SEQ ID NO: 1372 - protein, 34 aa, Artificial Sequence
  Computer-generated peptide variant
LFRFISRFFRRIRKPRAILWARKAAAAQNLTARK

SEQ ID NO: 1373 - protein, 95 aa, Artificial Sequence
  Computer-generated peptide variant
RWKYFKKLWRRLRQLSAKDCKANRSANRKLPYWRVAKKMLARLRRAFGLHVRRPALTYAPFTAPRIWKLVIERLLKEAPFTFATKALKQKWKREW

SEQ ID NO: 1374 - protein, 20 aa, Artificial Sequence
  Computer-generated peptide variant
IFKFLKRFMRKFKKVAAAPA

SEQ ID NO: 1375 - protein, 59 aa, Artificial Sequence
  Computer-generated peptide variant
KFKWLQRWLKLFKKRHKLYLCDLLALEKRHHDVERKKYLPRGRAIKAAHYRIIALTKNM

SEQ ID NO: 1376 - protein, 60 aa, Artificial Sequence
  Computer-generated peptide variant
MLKWFRRLFKRLRQESSRSVSAHAIYWKRRRKALKLQDYAPANLARLSKWSFKKERLAQQ

SEQ ID NO: 1377 - protein, 30 aa, Artificial Sequence
  Computer-generated peptide variant
KLRLYKKILKMLNRHLQKLIVCHLTKALVL

SEQ ID NO: 1378 - protein, 30 aa, Artificial Sequence
  Computer-generated peptide variant
KMKLFTRIYKLLCQCKDELKRKKAGWRATL

SEQ ID NO: 1379 - protein, 40 aa, Artificial Sequence
  Computer-generated peptide variant
LLRFLRKLLKWIKKAYAYRQEQTLERPILFRAILRLRYKV

SEQ ID NO: 1380 - protein, 92 aa, Artificial Sequence
  Computer-generated peptide variant
RFRFFQRWLRRLRSRLRAQKKKLWSDIWFHPELSHLINAKGAHRERAALRLKKLCRVTADTKRNRTWLRLKLKRKTNALRDRRLAKLVWLFL

SEQ ID NO: 1381 - protein, 63 aa, Artificial Sequence
  Computer-generated peptide variant
LMRYYQKFLRKYQCKRRKARVSLAACAVLYGAHYAVKLRFCARKAKVKKNQAAIRSALKAARF

SEQ ID NO: 1382 - protein, 59 aa, Artificial Sequence
  Computer-generated peptide variant
LWKWLKRLLKFFHRVAPKEGARQKRMKHLRIELAAMPRKWQSAADLIALAKILTACALR

SEQ ID NO: 1383 - protein, 64 aa, Artificial Sequence
  Computer-generated peptide variant
MWRLFRKMLKRLKRIKKAARCILDRYIAYLVKKPCAQQEKAELEKLENGPLRMAKLHWVKYAKK

SEQ ID NO: 1384 - protein, 45 aa, Artificial Sequence
  Computer-generated peptide variant
LWRLLRRFLRYWQKVIKVRVAFIKKLAKACLRTDKAAKTRPLFAH

SEQ ID NO: 1385 - protein, 30 aa, Artificial Sequence
  Computer-generated peptide variant
RLRLITRLYRKWCRSALNNKMKGLTYAGKK

SEQ ID NO: 1386 - protein, 96 aa, Artificial Sequence
  Computer-generated peptide variant
KFKYMKKLYKKYTQKQRLKPPRLLGRWKACNKRIEREWLVMLKAAARTAKAYKLRHVLEVARSLVKKHELTGFAKRELFLKLADISKHLLQYRRCT

SEQ ID NO: 1387 - protein, 20 aa, Artificial Sequence
  Computer-generated peptide variant
LLKYLTKFLKRLHKAKAVRR

SEQ ID NO: 1388 - protein, 30 aa, Artificial Sequence
  Computer-generated peptide variant
RLRWLRRLLKIFRTAAASMFCALTCHERDR

SEQ ID NO: 1389 - protein, 20 aa, Artificial Sequence
  Computer-generated peptide variant
KWKYYKKWLRKLNNALAKVA

SEQ ID NO: 1390 - protein, 27 aa, Artificial Sequence
  Computer-generated peptide variant
IIRLIPKWYRLFTKLYLRGARKAKDIA

SEQ ID NO: 1391 - protein, 27 aa, Artificial Sequence
  Computer-generated peptide variant
LLRWFKKIMKLLKRKAGLKSTQNLQRA

SEQ ID NO: 1392 - protein, 60 aa, Artificial Sequence
  Computer-generated peptide variant
ILKFLQKIWRRLSSIRLMRKILKAICRLAARKWSPAKKIREGWGQKAKPKVSLHRRSLAR

SEQ ID NO: 1393 - protein, 75 aa, Artificial Sequence
  Computer-generated peptide variant
KYKFLSKMMRYLKSARAAAGLVAIITKTRAALRSREALLLKRRQATKLWAPKLYLKRFLKPLRRFILTVYYEAFK

SEQ ID NO: 1394 - protein, 62 aa, Artificial Sequence
  Computer-generated peptide variant
KFKLWRRLFRRIHKMGLWVLKMIAKLYQLLWQRAEMKAAKLKKRPHTHLWYTAMSCKRAALA

SEQ ID NO: 1395 - protein, 33 aa, Artificial Sequence
  Computer-generated peptide variant
RLKFWPRYMKMLKKFMKARMNKHRAAKLDLTLS

SEQ ID NO: 1396 - protein, 73 aa, Artificial Sequence
  Computer-generated peptide variant
KFKWLKRWYKLLKKHIIWELLLLDTLAKRAAAYAALIAARKRYWQFYTAAEKWKRNDARAHSTKKRLIRTRVY

SEQ ID NO: 1397 - protein, 37 aa, Artificial Sequence
  Computer-generated peptide variant
MWKMLRKLYRRIRSDKAKLAIALRQSVLNDKDQRATR

SEQ ID NO: 1398 - protein, 20 aa, Artificial Sequence
  Computer-generated peptide variant
RIRLLRRLFRRMSQCFLKLL

SEQ ID NO: 1399 - protein, 37 aa, Artificial Sequence
  Computer-generated peptide variant
MFRLIKKIMRFFKRADAFACNRRARSALAFKFSRAWL

SEQ ID NO: 1400 - protein, 32 aa, Artificial Sequence
  Computer-generated peptide variant
FMRLLRKLIRKLQRAQPRWCWSRNCAAALKLA

SEQ ID NO: 1401 - protein, 69 aa, Artificial Sequence
  Computer-generated peptide variant
YMKIFRRLLKIMRSLCLLRPKVLTKLWFAPQLKARRCKGQRCRELKAVRQLLWNKRKAYLIDNLKKDAM

SEQ ID NO: 1402 - protein, 64 aa, Artificial Sequence
  Computer-generated peptide variant
LIRLLQRMLKKMQRYKCRSLKLLLMLLRKLLGRRTDNLSRVVRAAVYHGVRRDAWAYGTYKLRT

SEQ ID NO: 1403 - protein, 40 aa, Artificial Sequence
  Computer-generated peptide variant
YMRLLRKWFKKIKRLASTRKVKLKGAKQVAKFPYLDLWQY

SEQ ID NO: 1404 - protein, 44 aa, Artificial Sequence
  Computer-generated peptide variant
KFKFLRRFMKRWRKLRKHSSALKYRVVRRIPLATALIAVREAPA

SEQ ID NO: 1405 - protein, 38 aa, Artificial Sequence
  Computer-generated peptide variant
LMKFFRKWLKRLRKRPRCHQRLTLKLCQAYRLNLVVTS

SEQ ID NO: 1406 - protein, 32 aa, Artificial Sequence
  Computer-generated peptide variant
RFKYLCRYWRKLKCRRERIAQCLPRLHQAAAW

SEQ ID NO: 1407 - protein, 70 aa, Artificial Sequence
  Computer-generated peptide variant
KLKYFRRYWKRIPRLRAAALRQAKDTWVGRLLIATIGLKRMATSAALDHRVLKAKRRKNHKGKCLCHACR

SEQ ID NO: 1408 - protein, 100 aa, Artificial Sequence
  Computer-generated peptide variant
KLKMFRKMFRKYNTCGLLKYRSRDAHTRMLIAKLARCAKIAKKALLLFQTPAASKDLKHLMFFVLLGLLARKARNQCRQFLANHNAYVRLKKKADRAHEM

SEQ ID NO: 1409 - protein, 61 aa, Artificial Sequence
  Computer-generated peptide variant
KLRILRRLIKKMKRENGRLRRKLCAMYLRRYVTARNAWMVADKKTAYTRWKEAAYTSAAAR

SEQ ID NO: 1410 - protein, 33 aa, Artificial Sequence
  Computer-generated peptide variant
KLRLMQRWLKLLKKSLYWKWDIQAAKLDRKILV

SEQ ID NO: 1411 - protein, 60 aa, Artificial Sequence
  Computer-generated peptide variant
LFRLYHKWLRYYKTILYLLGWMHKRRHKRNLALLLKHRKKMSARKAVAAWFSKPAWSQIA

SEQ ID NO: 1412 - protein, 23 aa, Artificial Sequence
  Computer-generated peptide variant
LFRIFNKLIKRYRRLGAAKKAFW

SEQ ID NO: 1413 - protein, 32 aa, Artificial Sequence
  Computer-generated peptide variant
LYKILRRLFKMLRHQADYAVKVRARCKPMPLR

SEQ ID NO: 1414 - protein, 29 aa, Artificial Sequence
  Computer-generated peptide variant
LLRLFKRFFRWLPREALAVGLTRHKKKRL

SEQ ID NO: 1415 - protein, 21 aa, Artificial Sequence
  Computer-generated peptide variant
IMRYFRRLLKLYPCRKLARHH

SEQ ID NO: 1416 - protein, 72 aa, Artificial Sequence
  Computer-generated peptide variant
KYRLFRKIYRRYRRGATKVNRGMFLDLKKQRWALLQARILALFRRKKFPRHGHLKLTTALLNNALLCKSHAL

SEQ ID NO: 1417 - protein, 26 aa, Artificial Sequence
  Computer-generated peptide variant
RYRFLHKWFKLFKPLAHYKYLKVRAA

SEQ ID NO: 1418 - protein, 20 aa, Artificial Sequence
  Computer-generated peptide variant
MFKMLHRLLRMLCRMYRKKA

SEQ ID NO: 1419 - protein, 58 aa, Artificial Sequence
  Computer-generated peptide variant
ILRLLKKIWKKFPKADGVARGDRLGWVKMPIALAKLDKNEHRLARKHRKRLLRIKSFY

SEQ ID NO: 1420 - protein, 35 aa, Artificial Sequence
  Computer-generated peptide variant
RLKYLSKWWKLLKKFAKARTLRCAADPEDICKLHA

SEQ ID NO: 1421 - protein, 22 aa, Artificial Sequence
  Computer-generated peptide variant
LWRLLKRFLRKLRKKFYSLMMA

SEQ ID NO: 1422 - protein, 55 aa, Artificial Sequence
  Computer-generated peptide variant
YWRYFPRLLRRLKKEAALKLTRARKLCVLTLKLAFLERFKYLAKALQKKALEGRQ

SEQ ID NO: 1423 - protein, 41 aa, Artificial Sequence
  Computer-generated peptide variant
LFKLYQRMMKKYKRLLKERTWALCRKTGMRKEGMRLLAWGL

SEQ ID NO: 1424 - protein, 30 aa, Artificial Sequence
  Computer-generated peptide variant
FYRLLTRLFKKLHRRLYRKFSAQRWGVATL

SEQ ID NO: 1425 - protein, 69 aa, Artificial Sequence
  Computer-generated peptide variant
RWKLLKKLLRKFKKCGITHMTRNHLLHKARNANGRRVLIWRVKLIIFVAALRIAGKKLKKSFMNRVKLA

SEQ ID NO: 1426 - protein, 38 aa, Artificial Sequence
  Computer-generated peptide variant
RLKMLPRLLKIFSKKDVLQLNAYAGLHHKQWKRKTRAL

SEQ ID NO: 1427 - protein, 21 aa, Artificial Sequence
  Computer-generated peptide variant
WLKLFQKLLRLYKKFLRLAYR

SEQ ID NO: 1428 - protein, 67 aa, Artificial Sequence
  Computer-generated peptide variant
RLKMLNKLMRRFQRAAIGRVPELKTKKGIKLSFWKRRTPLVRARLFCNAIPLAAALGQKQLARARAK

SEQ ID NO: 1429 - protein, 32 aa, Artificial Sequence
  Computer-generated peptide variant
KFKILKKWMKKINPLWKMAACANRATCLRIAL

SEQ ID NO: 1430 - protein, 33 aa, Artificial Sequence
  Computer-generated peptide variant
KLKWLKRFLRKYRRLQLKCATLLHYKWWDMKWH

SEQ ID NO: 1431 - protein, 23 aa, Artificial Sequence
  Computer-generated peptide variant
MIKMLRRLIKKIKKLFALARNAD

SEQ ID NO: 1432 - protein, 48 aa, Artificial Sequence
  Computer-generated peptide variant
ILRMLRRLYRKYSKAGAGLERKYWSNLACAHKLLNLRWRADWMAFPRA

SEQ ID NO: 1433 - protein, 33 aa, Artificial Sequence
  Computer-generated peptide variant
LYRLLRRLLRKYRTPDPVLWARYLLVPRDNRRT

SEQ ID NO: 1434 - protein, 71 aa, Artificial Sequence
  Computer-generated peptide variant
FWKFLRRFWKWLKKGKTLAYALLKYADKRRQAARMRNHWTAQIKKKAWALYALASSKLMAGCLEKAYKKLT

SEQ ID NO: 1435 - protein, 21 aa, Artificial Sequence
  Computer-generated peptide variant
LFKIWKKYLRYLRKAATYKAM

SEQ ID NO: 1436 - protein, 42 aa, Artificial Sequence
  Computer-generated peptide variant
KLRMWQKMLRRFRRLRAQFSFRARDRAKAALQCMQQKLWAKR

SEQ ID NO: 1437 - protein, 42 aa, Artificial Sequence
  Computer-generated peptide variant
RLKLMTKIWKRYKKCLRKLRKTNAWAAARKLRLQLKAEWFAG

SEQ ID NO: 1438 - protein, 22 aa, Artificial Sequence
  Computer-generated peptide variant
KLKILCKLLRRYKTWASGALAY

SEQ ID NO: 1439 - protein, 27 aa, Artificial Sequence
  Computer-generated peptide variant
RYRLIKRLMRLMTRRLRHLAGAPAAAC

SEQ ID NO: 1440 - protein, 36 aa, Artificial Sequence
  Computer-generated peptide variant
RLKFMKRFWRFLTKTKEIHILRARTRGLLRAAMLAR

SEQ ID NO: 1441 - protein, 33 aa, Artificial Sequence
  Computer-generated peptide variant
LLRYLRRMLKKLPPRRAELQGKHARHCTDKCPR

SEQ ID NO: 1442 - protein, 39 aa, Artificial Sequence
  Computer-generated peptide variant
LIKYYCRYLRRLKSKALRTAWFTKCKSRNKLRKLAAALI

SEQ ID NO: 1443 - protein, 32 aa, Artificial Sequence
  Computer-generated peptide variant
LFKLLKRIWKLWKNKTLLKLKRMLLEDLRWSK

SEQ ID NO: 1444 - protein, 39 aa, Artificial Sequence
  Computer-generated peptide variant
ILRMLKKLWRFLQKRNNMSCRKNAPAKIFLLAPFAGAAR

SEQ ID NO: 1445 - protein, 20 aa, Artificial Sequence
  Computer-generated peptide variant
KLKLFKRYLRRMNQNAATQA

SEQ ID NO: 1446 - protein, 42 aa, Artificial Sequence
  Computer-generated peptide variant
FFKLWRKWFRKWKNRLRLLVLKAKMRMYVAMCLKPIYAALRS

SEQ ID NO: 1447 - protein, 83 aa, Artificial Sequence
  Computer-generated peptide variant
RLRLYRKLIRKLHRSALLMWDRLGNSPHAAAILQAARPDFLCAYKNLPSGKPRLAREGDTPRRLAAMEKHVRRAEAKLKVALV

SEQ ID NO: 1448 - protein, 82 aa, Artificial Sequence
  Computer-generated peptide variant
RMRIFKKFLKKFKKIAALKKVRWALLLKSEWKRIAKFNPLDMAYHQMWCLPLGRSAKRRAFEGAAKLAALALCEDRAVDRRA

SEQ ID NO: 1449 - protein, 27 aa, Artificial Sequence
  Computer-generated peptide variant
LIKLMRRWLKKYQTPLAKLQDSALQKW

SEQ ID NO: 1450 - protein, 56 aa, Artificial Sequence
  Computer-generated peptide variant
RIKLFKKLFRLWHPRQMNAPKIIWVKKAADGCLAIAKKKPMKHQKKLLALKLPFKL

SEQ ID NO: 1451 - protein, 45 aa, Artificial Sequence
  Computer-generated peptide variant
RIKIFRKLWKLFRHQCLLYAKGRERHTYFRAQVNRAKLAAHKKLP

SEQ ID NO: 1452 - protein, 78 aa, Artificial Sequence
  Computer-generated peptide variant
RYRFLKKIFKRYTSCAKVKPKAAPHAKNRRRLRKRLLRRIPAKKKLALHAAMISDASKQAVLAADKRAAMMANHRQTK

SEQ ID NO: 1453 - protein, 45 aa, Artificial Sequence
  Computer-generated peptide variant
RWKWFTRFYKRFRRRARSELRIAKKRNLDLLLLPAQPLRIRTLTI

SEQ ID NO: 1454 - protein, 29 aa, Artificial Sequence
  Computer-generated peptide variant
LLKYFQRMLKIYKSWAGWLQLLMRNKRKA

SEQ ID NO: 1455 - protein, 61 aa, Artificial Sequence
  Computer-generated peptide variant
RLKMFKKFLRLWRKHACKSLAEGWLSRHEWRMGRRLDKSKPEEAKKADRAKLKLRILYMYS

SEQ ID NO: 1456 - protein, 30 aa, Artificial Sequence
  Computer-generated peptide variant
RLRLMTKLYKRFRKKPLALLLMRAYGINKK

SEQ ID NO: 1457 - protein, 56 aa, Artificial Sequence
  Computer-generated peptide variant
ILRFLKKWFKRFKRVRHKMILMRGAMGIWTARRAAAKNYKRMLLVLGAGVKARRHC

SEQ ID NO: 1458 - protein, 86 aa, Artificial Sequence
  Computer-generated peptide variant
LIKFLKRIIKRYKSLALLRCRYIWILIRATLTCKHRAKSQEAGLGNRKEAKARWHARRKNKQGATRVRVAHKKTAVAKLIVLGGLK

SEQ ID NO: 1459 - protein, 43 aa, Artificial Sequence
  Computer-generated peptide variant
LYKFLRRMMRKLKHRILIKFVWRNTPAQALKKHRAKRLTALHL

SEQ ID NO: 1460 - protein, 40 aa, Artificial Sequence
  Computer-generated peptide variant
FLKLLCKWWRLIKKLCRKLRFHRAKATLGAWPLKQKTVFP

SEQ ID NO: 1461 - protein, 88 aa, Artificial Sequence
  Computer-generated peptide variant
FFKLLPRFLKWFQTAESRLSAAKKLTWAALLKKVRLKMKANKKWWLLKLALPGHFWAFRHKLDEWCTNKAMCRKSRILIKEGRHLARK

SEQ ID NO: 1462 - protein, 22 aa, Artificial Sequence
  Computer-generated peptide variant
LLRFIQRLIRKLPKRCCLASQA

SEQ ID NO: 1463 - protein, 62 aa, Artificial Sequence
  Computer-generated peptide variant
KIKLMTRLFRLLPRTKQAFAVAYPLWAAAQKRKLCKAALPKAHKHAIARFLVKQLSKKAKKL

SEQ ID NO: 1464 - protein, 72 aa, Artificial Sequence
  Computer-generated peptide variant
MIRFLHRWIRKWKKEVLQWKKAKAWANARAHAHYRSAKHLKALAHWRLWRAALELHTKLKIQAHMGRMLAKM

SEQ ID NO: 1465 - protein, 47 aa, Artificial Sequence
  Computer-generated peptide variant
KIKILKRLFKWLRRLSGADLKANDNAKACAHGQRLAQYAQLHMANKN

SEQ ID NO: 1466 - protein, 84 aa, Artificial Sequence
  Computer-generated peptide variant
LLKWFKKMYKLFPPMLTRRRKRKMKNKDAGALVHGIRRRDARLIWRVLTMAALEARKKMRLRRGRAFAQCFRKAAHGLACLKCM

SEQ ID NO: 1467 - protein, 22 aa, Artificial Sequence
  Computer-generated peptide variant
RYRLWCRYFRFLSKRAFLLARH

SEQ ID NO: 1468 - protein, 26 aa, Artificial Sequence
  Computer-generated peptide variant
KYRMLSKMFRLIRKLKGNKLNVAAGA

SEQ ID NO: 1469 - protein, 22 aa, Artificial Sequence
  Computer-generated peptide variant
FFRMFKKFLKRLNCKLAALRLH

SEQ ID NO: 1470 - protein, 23 aa, Artificial Sequence
  Computer-generated peptide variant
RLRIIRRYWKWYKRLCLAAHLLS

SEQ ID NO: 1471 - protein, 50 aa, Artificial Sequence
  Computer-generated peptide variant
RWRMFRRLFKIFHTQRGLAEISCLKALCRLRNALKADRKAKGEPKAMRKH

SEQ ID NO: 1472 - protein, 51 aa, Artificial Sequence
  Computer-generated peptide variant
RWKWYCRFLKKFPSLKKANLWLKNLAYRHWRLAYKLRITRTADAILCRLKR

SEQ ID NO: 1473 - protein, 27 aa, Artificial Sequence
  Computer-generated peptide variant
MLRLFRRLIRKYTKAKLLCFERPAKLR

SEQ ID NO: 1474 - protein, 23 aa, Artificial Sequence
  Computer-generated peptide variant
RLKFFKRWWRKLPQAARAARNND

SEQ ID NO: 1475 - protein, 40 aa, Artificial Sequence
  Computer-generated peptide variant
WYRLLRKFMRMLQCLSKFIAIFDLRLLAASKFGKRKPFRA

SEQ ID NO: 1476 - protein, 29 aa, Artificial Sequence
  Computer-generated peptide variant
LLKILKRIYKKLKKALQRMGHRMTGLIAT

SEQ ID NO: 1477 - protein, 32 aa, Artificial Sequence
  Computer-generated peptide variant
KLKFWRKIFRLLKPAGLSTADLRAKKRNNGKS

SEQ ID NO: 1478 - protein, 63 aa, Artificial Sequence
  Computer-generated peptide variant
KFRIINKMYRWLRHLAKKLRWRQKWKWAAAKRWAKRLDPRWWDKRVQLLRMKAECAEGLACGE

SEQ ID NO: 1479 - protein, 21 aa, Artificial Sequence
  Computer-generated peptide variant
KFRLLRRMLRLWKRSFMQAAA

SEQ ID NO: 1480 - protein, 28 aa, Artificial Sequence
  Computer-generated peptide variant
FWKLLRKLFRWLNKLARFMEAKPRLKRH

SEQ ID NO: 1481 - protein, 49 aa, Artificial Sequence
  Computer-generated peptide variant
KLRMMRRLWKRLQRRYAYLALASELRLGNWKWNSELQSPIRCKKAKLFK

SEQ ID NO: 1482 - protein, 37 aa, Artificial Sequence
  Computer-generated peptide variant
RLKYWTKILKMLSKYLLEKAHAATRNTCRRKAALAKW

SEQ ID NO: 1483 - protein, 41 aa, Artificial Sequence
  Computer-generated peptide variant
LIKWIRKIFKRFPRSKRRIAKAYLKKRAAASRLSGLQINAV

SEQ ID NO: 1484 - protein, 86 aa, Artificial Sequence
  Computer-generated peptide variant
KWRLLRKMLRKLRTKKASAMAWLAAASLSCKERLNWVECKQGLQCFFCIVKIGAKLYKRHTLKAKKQDKNKDLAKMDQRMRAILKR

SEQ ID NO: 1485 - protein, 20 aa, Artificial Sequence
  Computer-generated peptide variant
KLKFYKRFLKMYQKRLQAAS

SEQ ID NO: 1486 - protein, 32 aa, Artificial Sequence
  Computer-generated peptide variant
LFKLLCKLLRRFSRANLRMRGMLRLKKFCMYQ

SEQ ID NO: 1487 - protein, 65 aa, Artificial Sequence
  Computer-generated peptide variant
LYRLIKKIFKLLTSAKSNSWLFAKFLWLKLNKRRKKMLILKNLARQWGKLFKCAKLLFAAICALV

SEQ ID NO: 1488 - protein, 50 aa, Artificial Sequence
  Computer-generated peptide variant
FYKLMCKYLKLIRPHAAKRKQNAAKHAAKYYTRKLADMQLWYLKPKLRVY

SEQ ID NO: 1489 - protein, 47 aa, Artificial Sequence
  Computer-generated peptide variant
RIRLLRRLLRYITRKRSAIKVYAMKAGIMGARHKCYWKLQLELKIPL

SEQ ID NO: 1490 - protein, 38 aa, Artificial Sequence
  Computer-generated peptide variant
RYKLFKKWLRRMRNDRDAPQALLCLLLFAFKQERFLVW

SEQ ID NO: 1491 - protein, 96 aa, Artificial Sequence
  Computer-generated peptide variant
LIRYLRRLLKLFKKALGHAKKYQMWLALDGFRQNWYKHLREMKQLMQKAGKKFCKVTRRKAAVKKIQELKKLNFAELKKRVFREYLKYCRAWKFHL

SEQ ID NO: 1492 - protein, 29 aa, Artificial Sequence
  Computer-generated peptide variant
YIRYLKKLLKRFSKLLIMDATLALQKPAK

SEQ ID NO: 1493 - protein, 26 aa, Artificial Sequence
  Computer-generated peptide variant
KLKLLTRFFKLWSTRKRLLIFIKRAI

SEQ ID NO: 1494 - protein, 30 aa, Artificial Sequence
  Computer-generated peptide variant
RIKLIKRIFRRYRKRRLLFDAELAKLAMVV

SEQ ID NO: 1495 - protein, 74 aa, Artificial Sequence
  Computer-generated peptide variant
WFKLFCKLWKKIKSQEALITAWLRKALKTPICKKLRADARARARWRALFRHGKVNLNCKLRRYATGAPKQLMHQ

SEQ ID NO: 1496 - protein, 52 aa, Artificial Sequence
  Computer-generated peptide variant
MMKILTKYLRKMNPLLDFILASKKYRRWVLPQVLSSALRLLKKGARKKALRA

SEQ ID NO: 1497 - protein, 42 aa, Artificial Sequence
  Computer-generated peptide variant
RYKLLKKLIRIFKKKTLAKLADYLRRKAQPARMGNVLGLHNP

SEQ ID NO: 1498 - protein, 40 aa, Artificial Sequence
  Computer-generated peptide variant
YLRLIPRFLRYLKKRIALIRFRSGYAKARIKNALERLVLG

SEQ ID NO: 1499 - protein, 67 aa, Artificial Sequence
  Computer-generated peptide variant
FFKLFPRLLKRLKNHEGLNCARHARLLITAVPREAQMGKKPARRLQGRKLRRQSGGAYKAAYRKWKQ

SEQ ID NO: 1500 - protein, 78 aa, Artificial Sequence
  Computer-generated peptide variant
KIRWLHRMIKLFNKLVTRSLLKHTKKRDALRKHHKAWALAPKTCRPRKRKAEWKLLKKAYAAYLDRYTLHLKAGKASW

SEQ ID NO: 1501 - protein, 43 aa, Artificial Sequence
  Computer-generated peptide variant
RMRLLKKWWKRLRKAKERWLKGSKAAAGNHFGLDCGNADHRKY

SEQ ID NO: 1502 - protein, 44 aa, Artificial Sequence
  Computer-generated peptide variant
IYRFFRKLLRWYRPRYIMMLRKRARAVHAAIRRLCLKKELPCLT

SEQ ID NO: 1503 - protein, 60 aa, Artificial Sequence
  Computer-generated peptide variant
KIKLFNKLMKRLTKSQLLMACLLKKRAAMMRPKLQSVAKKLHDFEAQFRNVSKKKHRERY

SEQ ID NO: 1504 - protein, 33 aa, Artificial Sequence
  Computer-generated peptide variant
KMKLLKKFFKMLSRHLVLRDCKLAATLKKKKGG

SEQ ID NO: 1505 - protein, 27 aa, Artificial Sequence
  Computer-generated peptide variant
RWKLLPRWLKRIKKHAHLYGYLTREGA

SEQ ID NO: 1506 - protein, 52 aa, Artificial Sequence
  Computer-generated peptide variant
RIRWFKKFMRMLPKALVTQFRLDKYLAKRAWLKALILLLKLLRKFGIIQTVQ

SEQ ID NO: 1507 - protein, 38 aa, Artificial Sequence
  Computer-generated peptide variant
LLRYYNRIFKRFPTFKDKRMYAARHLLASKGLQRQLAR

SEQ ID NO: 1508 - protein, 29 aa, Artificial Sequence
  Computer-generated peptide variant
FLKYLSRLIRRFNRRTYLLMNNLTLKKLR

SEQ ID NO: 1509 - protein, 41 aa, Artificial Sequence
  Computer-generated peptide variant
RYKILNKLLKIMCQRACALRKKQAEKWLAARDHKQEMAAAY

SEQ ID NO: 1510 - protein, 74 aa, Artificial Sequence
  Computer-generated peptide variant
KFKFWRRIFRKLKPNRAPHAFAKFMAFARKSPDLMNKLDMWLARTYPKALKQRKGHNLKKAAKIAALRLNALFH

SEQ ID NO: 1511 - protein, 32 aa, Artificial Sequence
  Computer-generated peptide variant
WLKLYRKLFRRLTKSACADKAPTALLLRKKAR

SEQ ID NO: 1512 - protein, 28 aa, Artificial Sequence
  Computer-generated peptide variant
YLRILNKWLRFMRNSCAILKARKEAKAV

SEQ ID NO: 1513 - protein, 71 aa, Artificial Sequence
  Computer-generated peptide variant
FYRFLQRLWKKMKRKAARIILLQHPLGQKKCAAFRCFHKKATRQWAMVALRHKRALAYLLCLAAKECIKNK

SEQ ID NO: 1514 - protein, 55 aa, Artificial Sequence
  Computer-generated peptide variant
RFRLFKRFLKRLKKKMCAGPRDALFERECRQYARAGLAFPLDLWRASMGTAARKW

SEQ ID NO: 1515 - protein, 54 aa, Artificial Sequence
  Computer-generated peptide variant
RYKFLKKLWKWLRKLEEKSQMCSWRFAKRNTFLAWKKVAWRKAVKAAVNLLHRL

SEQ ID NO: 1516 - protein, 23 aa, Artificial Sequence
  Computer-generated peptide variant
KFRMLRRFLKRYRNAAFAASKAA

SEQ ID NO: 1517 - protein, 35 aa, Artificial Sequence
  Computer-generated peptide variant
FLKFLTRMLKFYHNRLRARKTDATCCALKLKQCLK

SEQ ID NO: 1518 - protein, 38 aa, Artificial Sequence
  Computer-generated peptide variant
LIKLMNKYMKKLKKKCGDAARSLKAPLWNRRKRLYDAH

SEQ ID NO: 1519 - protein, 43 aa, Artificial Sequence
  Computer-generated peptide variant
KWKLWRKFIKKLRCPKLLADLLTDMKNRTAHRINLCAMAYAKA

SEQ ID NO: 1520 - protein, 20 aa, Artificial Sequence
  Computer-generated peptide variant
IFKYMNKLLRYLKRLSRPAV

SEQ ID NO: 1521 - protein, 58 aa, Artificial Sequence
  Computer-generated peptide variant
RIRWFSKFFRWLRKAKSTKLKHTRKLIRLVLAKRYFRLLYARLYSWKCLVLLTLHKVF

SEQ ID NO: 1522 - protein, 55 aa, Artificial Sequence
  Computer-generated peptide variant
LLKLYPKILKRWKQMAYRQLVAAEFQEDKKMCKFPRRRTREYALAKRKTARAHHL

SEQ ID NO: 1523 - protein, 45 aa, Artificial Sequence
  Computer-generated peptide variant
FFKWFKKIMKLWCRRQKASLRYLRLRCRAYLLLKLARQWRAPLIQ

SEQ ID NO: 1524 - protein, 90 aa, Artificial Sequence
  Computer-generated peptide variant
RLKLIKRLLKIFRTLFKPAWFGRFRKYKDGKERKLAEFLAYALRTTLPRLRKVDNRVHRLLTRIPKAKFLHDKNPRCLLRLSAGAKKRYN

SEQ ID NO: 1525 - protein, 22 aa, Artificial Sequence
  Computer-generated peptide variant
LLRYLRKLMRKWRKWALCHYNY

SEQ ID NO: 1526 - protein, 29 aa, Artificial Sequence
  Computer-generated peptide variant
FFRLLKKLWRKLTPKVAAKLRESIFAYML

SEQ ID NO: 1527 - protein, 20 aa, Artificial Sequence
  Computer-generated peptide variant
IFKFICRLLKRLNKQLELLN

SEQ ID NO: 1528 - protein, 95 aa, Artificial Sequence
  Computer-generated peptide variant
LFRWYRRLLRKLSSHQIAAWKRATFRLTNLLRLTAKRELIADHRKWARFAIKNKNKCKLIAPNVIRCPKKLVRKDGRAQAWRLDTLKTHKKACLN

SEQ ID NO: 1529 - protein, 28 aa, Artificial Sequence
  Computer-generated peptide variant
LWRMLRRIFRRLSKVMMSLKLNAKWALG

SEQ ID NO: 1530 - protein, 34 aa, Artificial Sequence
  Computer-generated peptide variant
WFRLFKKLYKLMRQKRELRVNMLCPNKLAAIRAM

SEQ ID NO: 1531 - protein, 33 aa, Artificial Sequence
  Computer-generated peptide variant
RFKYLKKFLKRLKTLIKLPRYEFLAPWLDYKAK

SEQ ID NO: 1532 - protein, 34 aa, Artificial Sequence
  Computer-generated peptide variant
RIRWIRRYLKFLCKWAKLSLQKLKNMWAKAWEKN

SEQ ID NO: 1533 - protein, 35 aa, Artificial Sequence
  Computer-generated peptide variant
LYRLWNKFIRKFRRLALKEFLDALLMSVIRANKRL

SEQ ID NO: 1534 - protein, 25 aa, Artificial Sequence
  Computer-generated peptide variant
WLRYYRKLLKLFCRKFQKRLACWYA

SEQ ID NO: 1535 - protein, 55 aa, Artificial Sequence
  Computer-generated peptide variant
RLKWLCKLLRRWHKVSRPTLRVDKREYGAEHALRMYACPKRRAACANAARYSARA

SEQ ID NO: 1536 - protein, 56 aa, Artificial Sequence
  Computer-generated peptide variant
FFRLLCKFLRKLCRKKATRAAKDLFDNVKECANRLRPADLYKHWLKGKMAKKAFRT

SEQ ID NO: 1537 - protein, 32 aa, Artificial Sequence
  Computer-generated peptide variant
LLRLIKKFLRKIPQKRRRRMLWRAWALQRITA

SEQ ID NO: 1538 - protein, 43 aa, Artificial Sequence
  Computer-generated peptide variant
IWKLYRRFLKFMRKKMHWLRAANRYFLLIALFLLHLAFTRIRS

SEQ ID NO: 1539 - protein, 23 aa, Artificial Sequence
  Computer-generated peptide variant
RWKFLRKFWKLFTRRPLAAQLLI

SEQ ID NO: 1540 - protein, 85 aa, Artificial Sequence
  Computer-generated peptide variant
ILRLFTKMLRYLPCAALLTVTILRTEIVDARRLRLFKCLFLKRLRERFQKLRAPGELAQAAQAYLLGDKVVKHTGLTLTRRKPKA

SEQ ID NO: 1541 - protein, 27 aa, Artificial Sequence
  Computer-generated peptide variant
KLRLLKKLLKRYCPQMCTAQAHGFAVK

SEQ ID NO: 1542 - protein, 36 aa, Artificial Sequence
  Computer-generated peptide variant
KFKLFRKLFRMWRHAADALKGKLRKQYTVSASDATR

SEQ ID NO: 1543 - protein, 41 aa, Artificial Sequence
  Computer-generated peptide variant
RIRLYCKLYRRLSRCASRCRFIALKRKLRELYFPKDYRAAY

SEQ ID NO: 1544 - protein, 28 aa, Artificial Sequence
  Computer-generated peptide variant
LLRLWQKLWRKLRNHWLRTQYLRAAYDH

SEQ ID NO: 1545 - protein, 22 aa, Artificial Sequence
  Computer-generated peptide variant
IFKLWKRYLRILHQKLPALRPR

SEQ ID NO: 1546 - protein, 27 aa, Artificial Sequence
  Computer-generated peptide variant
MLRYLTRFLRKISKAAAKKMCPGKYAL

SEQ ID NO: 1547 - protein, 34 aa, Artificial Sequence
  Computer-generated peptide variant
RLRFLHRFLKLIRKALRPAYRYTSKRYLIFDGLW

SEQ ID NO: 1548 - protein, 57 aa, Artificial Sequence
  Computer-generated peptide variant
MIKYYRKFFKILRKRVWALINGKKLLATAALVMKATWLAKHSKKVRRKPQIARGLTR

SEQ ID NO: 1549 - protein, 42 aa, Artificial Sequence
  Computer-generated peptide variant
KLRLLRKWLKRIRQRQKLLVKLPARLDRRPQSKLSKRLLHDS

SEQ ID NO: 1550 - protein, 45 aa, Artificial Sequence
  Computer-generated peptide variant
KLKIMNRFLKKWSSAFIKILHKLKLIKTLAKALKAMQLVGLQHFR

SEQ ID NO: 1551 - protein, 21 aa, Artificial Sequence
  Computer-generated peptide variant
RLRLFNRLYKILKPHARRNLK

SEQ ID NO: 1552 - protein, 65 aa, Artificial Sequence
  Computer-generated peptide variant
KMKIFQRLLRWYRSDARLRSIHRANRIPHMLLRAKKARLANRIYMVALAAYWKNHRSQAEKASKL

SEQ ID NO: 1553 - protein, 27 aa, Artificial Sequence
  Computer-generated peptide variant
MMRLMPRLFRRIKQTLQAHKRLSANLK

SEQ ID NO: 1554 - protein, 29 aa, Artificial Sequence
  Computer-generated peptide variant
LYKWWKRLMRLLKNPKTCLTRAARWANSL

SEQ ID NO: 1555 - protein, 32 aa, Artificial Sequence
  Computer-generated peptide variant
RMKFLRKLLKKLCRQYYEIKVALLYAYRAHAH

SEQ ID NO: 1556 - protein, 37 aa, Artificial Sequence
  Computer-generated peptide variant
KLRYLQRFLKRFNHSAFRARPLKLDAMMLWLKIRLFI

SEQ ID NO: 1557 - protein, 34 aa, Artificial Sequence
  Computer-generated peptide variant
YLKLLRKLLKYLRSKLQIYIPQVYRYYARKKALH

SEQ ID NO: 1558 - protein, 61 aa, Artificial Sequence
  Computer-generated peptide variant
KLRWFRRIIRKLKKNRELRYTSAAARRSCNRIAWSVALTLAWETRFWLKMVYKRVKAADKK

SEQ ID NO: 1559 - protein, 25 aa, Artificial Sequence
  Computer-generated peptide variant
LWKLWRKILKKLRHEMRLHKAHATA

SEQ ID NO: 1560 - protein, 38 aa, Artificial Sequence
  Computer-generated peptide variant
KLRWLKKWMKKMRRECTRAIYKPALDSAKLCAKPWHCL

SEQ ID NO: 1561 - protein, 29 aa, Artificial Sequence
  Computer-generated peptide variant
FLRLFCKLYKWYHKLLLALRKTGGIRRKL

SEQ ID NO: 1562 - protein, 37 aa, Artificial Sequence
  Computer-generated peptide variant
RLRLIKKFYRYWSRASLLARWALNLKANYYRKKDVHR

SEQ ID NO: 1563 - protein, 35 aa, Artificial Sequence
  Computer-generated peptide variant
KLRFYRRLLKFFKRMVKPAMSARALKLAMPCLLTQ

SEQ ID NO: 1564 - protein, 63 aa, Artificial Sequence
  Computer-generated peptide variant
WLKLLKRMLRLLPKRRKTRSSALWNTDANVKAGLELGAGHKRMKPVRRLRSLEWARLAKPAKR

SEQ ID NO: 1565 - protein, 58 aa, Artificial Sequence
  Computer-generated peptide variant
RLKWLKRLLRRFHKKKCLKVPHRWLELDRDHLKRALCGREILAVFCSPRWLSLLLFAG

SEQ ID NO: 1566 - protein, 34 aa, Artificial Sequence
  Computer-generated peptide variant
RFRFWKKFLRLFNRKHKDNQAANRLSAGRLANTR

SEQ ID NO: 1567 - protein, 51 aa, Artificial Sequence
  Computer-generated peptide variant
LWRYIKKLLRWLRCLLRVAEALIFARRDHRARLWIRLKCKTKLVSCRMRQG

SEQ ID NO: 1568 - protein, 47 aa, Artificial Sequence
  Computer-generated peptide variant
LLRIYRRLLKKWSRAGRHREGAQLKARNLLRSTMKMRVYATMARHYK

SEQ ID NO: 1569 - protein, 56 aa, Artificial Sequence
  Computer-generated peptide variant
RLRWLTRWYRKWNKMHLELKHHGLLKLAKRLSKLAHLQLLRLQKSELDILRDFPSP

SEQ ID NO: 1570 - protein, 41 aa, Artificial Sequence
  Computer-generated peptide variant
WYRLLTRFMKKLKKKLPVRYAAAKYLRQDKIYAGRVCLIKI

SEQ ID NO: 1571 - protein, 65 aa, Artificial Sequence
  Computer-generated peptide variant
FFRLWRRLLRFLRKHYALAKWKTAEGAKPLAEAYARRALYQQVLMIHKLKESRDRHAFKNMNLAH

SEQ ID NO: 1572 - protein, 64 aa, Artificial Sequence
  Computer-generated peptide variant
LIKFLSRWWKRMKPAMRKFKALQKLLMRKYYTEHAWLRPFKAPSYMKALKFRLKQLLKNKKKWT

SEQ ID NO: 1573 - protein, 41 aa, Artificial Sequence
  Computer-generated peptide variant
RYRFFRRIMKRLHKDIRKGRLAFDAAAAKVCKPAISKKLHA

SEQ ID NO: 1574 - protein, 40 aa, Artificial Sequence
  Computer-generated peptide variant
KLKYMKKWFKLFSRALNHLPISKALRNHRICAVRLVKKTR

SEQ ID NO: 1575 - protein, 65 aa, Artificial Sequence
  Computer-generated peptide variant
RLRLFKRWLKLYRQVALIAAAFRKKKDFAQAHKTKLAMPLKGKARRTVVLHLMEACKRDRYFLAL

SEQ ID NO: 1576 - protein, 29 aa, Artificial Sequence
  Computer-generated peptide variant
RLKYLRKLLRRYKKSLSLLLWSRVREYGA

SEQ ID NO: 1577 - protein, 56 aa, Artificial Sequence
  Computer-generated peptide variant
KLKFFNKIWRLLRPLLLLTKPYLKCLFLRPFKNKASFKGKDAKAHKLRFAVIAKNI

SEQ ID NO: 1578 - protein, 59 aa, Artificial Sequence
  Computer-generated peptide variant
RLKLLKRILKWWKKTMTRKRLAKGIVAPAKLTESWALCLALYQEYRKANFDRWLNRRMP

SEQ ID NO: 1579 - protein, 25 aa, Artificial Sequence
  Computer-generated peptide variant
RFRLLKKLLKRFTHAREFTLQRWHQ

SEQ ID NO: 1580 - protein, 38 aa, Artificial Sequence
  Computer-generated peptide variant
IYRWFCRLWKLIRTILRRQLKRREARAKAAHKATAHHN

SEQ ID NO: 1581 - protein, 31 aa, Artificial Sequence
  Computer-generated peptide variant
WWKMLKKIIKLLKREAANNCKADAACAVRKY

SEQ ID NO: 1582 - protein, 67 aa, Artificial Sequence
  Computer-generated peptide variant
RLRWLKRLYRFFKCTTISKLQKKLRNKLLARTRCRRGKRQAQDLALLPAQWRVLYMWCKRPQCACNA

SEQ ID NO: 1583 - protein, 52 aa, Artificial Sequence
  Computer-generated peptide variant
RWRWFTKLYRRLTKRRAAIFRQRAYNACRTTMAYKYIKYAAKFAALGRLKCM

SEQ ID NO: 1584 - protein, 34 aa, Artificial Sequence
  Computer-generated peptide variant
LLRYLSRFIKYFHKEKSRAELRRRRWKKAALAKA

SEQ ID NO: 1585 - protein, 42 aa, Artificial Sequence
  Computer-generated peptide variant
LMKFLHRYWKLWKKAQEYPYARLQREALERAAAKERILLAMK

SEQ ID NO: 1586 - protein, 27 aa, Artificial Sequence
  Computer-generated peptide variant
LFRMLRRWLKLWQRKAKVKSCAQLSLK

SEQ ID NO: 1587 - protein, 24 aa, Artificial Sequence
  Computer-generated peptide variant
LYKLLKRYWKKMRHARACLDAKRP

SEQ ID NO: 1588 - protein, 20 aa, Artificial Sequence
  Computer-generated peptide variant
KYKLYKRYMKLMNKMAKPAA

SEQ ID NO: 1589 - protein, 25 aa, Artificial Sequence
  Computer-generated peptide variant
FLRLLRRLYKRIKRKHEQAPAFSPL

SEQ ID NO: 1590 - protein, 26 aa, Artificial Sequence
  Computer-generated peptide variant
KLRLFSRLYKFLHKHYNWFRLVAALR

SEQ ID NO: 1591 - protein, 67 aa, Artificial Sequence
  Computer-generated peptide variant
MMRLIKRIWKWLRTVRKCDDALRREDAYLLKALWTNKKTQLAKLCLRKRLLMRWYRLLMEDQKYVAL

SEQ ID NO: 1592 - protein, 100 aa, Artificial Sequence
  Computer-generated peptide variant
KYRFFSRFLKWWQCKGLRKPKNAVLAILKRRQAKDTPEAGPWAKKLRKNHAKLYRKLCRAKRLAPKERLGSLITFKQRCSAWAVPALARIVCRHLRLKYT

SEQ ID NO: 1593 - protein, 34 aa, Artificial Sequence
  Computer-generated peptide variant
IWRYYTRMFKRLSRLLILMLRKFRLRACMTRGAA

SEQ ID NO: 1594 - protein, 23 aa, Artificial Sequence
  Computer-generated peptide variant
WLRLLTKLLRKLRKLKKPMANCT

SEQ ID NO: 1595 - protein, 28 aa, Artificial Sequence
  Computer-generated peptide variant
KIKWMPRLLKLLKPKADKSVGKRDAHAH

SEQ ID NO: 1596 - protein, 27 aa, Artificial Sequence
  Computer-generated peptide variant
KWKLLQRLLKRMKSLCWKKLDPLVKMT

SEQ ID NO: 1597 - protein, 38 aa, Artificial Sequence
  Computer-generated peptide variant
LLRLWRRLMKKLHRRVAFEHAYPAKAYKWLGAQARELT

SEQ ID NO: 1598 - protein, 20 aa, Artificial Sequence
  Computer-generated peptide variant
WLRFFRKFFKMLTSKMAAAA

SEQ ID NO: 1599 - protein, 70 aa, Artificial Sequence
  Computer-generated peptide variant
KFKLLPKLIRLWKRDRDWLASLRTLLALGLKRAWKNIIRMLDGKERGQSLILLCFRLRRKLIKYVAKNKK

SEQ ID NO: 1600 - protein, 41 aa, Artificial Sequence
  Computer-generated peptide variant
LWKMLKKFLRKLNPLWELKKFPALCDLALRKLGWEDYTKRA

SEQ ID NO: 1601 - protein, 39 aa, Artificial Sequence
  Computer-generated peptide variant
KMRLFKRFLRKWSRAWLGKLQASKRAADARYYNKEANWE

SEQ ID NO: 1602 - protein, 33 aa, Artificial Sequence
  Computer-generated peptide variant
WFRMLKRMLKKLPRIAACLRDLCIAKYLNRTLY

SEQ ID NO: 1603 - protein, 41 aa, Artificial Sequence
  Computer-generated peptide variant
RWRLLHKLWKLLKKLIKASLRTRFYKDLPAYCAVAALCLKG

SEQ ID NO: 1604 - protein, 29 aa, Artificial Sequence
  Computer-generated peptide variant
FFRMFKRMWRLLRREANIPAALPLTRRLH

SEQ ID NO: 1605 - protein, 61 aa, Artificial Sequence
  Computer-generated peptide variant
RLRYLKRLMKRYRKLPMARRTVRDAYRLLLTRRSCHPALAMLLAEHYHRPAWYRYKIKLKY

SEQ ID NO: 1606 - protein, 34 aa, Artificial Sequence
  Computer-generated peptide variant
RMKLLTRLLRYLKRLGAVERKLAAQPNLNWWQRI

SEQ ID NO: 1607 - protein, 92 aa, Artificial Sequence
  Computer-generated peptide variant
KFKMLHKLWKKFCKDHFRLRAECQCHEKSKHLLKLRLETKLIKTARMRKLAKAQYAARVVLCTKHYKRSKHTLLRKYLPLARAAKLPKEHKR

SEQ ID NO: 1608 - protein, 33 aa, Artificial Sequence
  Computer-generated peptide variant
LFKFLTKMLRKFHNILRSAIYKRKLDELRAGAL

SEQ ID NO: 1609 - protein, 24 aa, Artificial Sequence
  Computer-generated peptide variant
WLRFLRKLIKLFTKPLQKSQFRLA

SEQ ID NO: 1610 - protein, 63 aa, Artificial Sequence
  Computer-generated peptide variant
KFKFFHKFLKLMKTESLWRAWTLWKMAAEKATRANSLKFKAILRAKKPALDCLLLFGHLFKAE

SEQ ID NO: 1611 - protein, 85 aa, Artificial Sequence
  Computer-generated peptide variant
MWRLLRKFLRKLKPRWNHLNHKVIAKHLAAKFRARKKHVWARLLSAERPHTFKADFDKHRLAKSQQARLQPKREDTWLLTMLERR

SEQ ID NO: 1612 - protein, 30 aa, Artificial Sequence
  Computer-generated peptide variant
MFKLWKKFLRRMKRAKALVAVKWQLADKLK

SEQ ID NO: 1613 - protein, 28 aa, Artificial Sequence
  Computer-generated peptide variant
FLRLFKRLLKRLTCDRAGAHSSGKRFLA

SEQ ID NO: 1614 - protein, 44 aa, Artificial Sequence
  Computer-generated peptide variant
FIKLFHKLWRYIRNNDWLLAKKLLKTRRFRRKAANKAGCDCLGR

SEQ ID NO: 1615 - protein, 37 aa, Artificial Sequence
  Computer-generated peptide variant
RLKLLKRLIKRLKHAALKAHAWRKACRSDYPFLHQWL

SEQ ID NO: 1616 - protein, 66 aa, Artificial Sequence
  Computer-generated peptide variant
KWRLITRLMKKFKCRLCKDLWHKEHHAAELRYPKAKCAKAWALKCKKLKNKEARWKSTLLLGKHLF

SEQ ID NO: 1617 - protein, 66 aa, Artificial Sequence
  Computer-generated peptide variant
RLRLWRRFYRLFNHVAKKKKWFYEALKLLAFRCIGFRCAAKACDKYMTLKAEKKQMWMGKKKAGAK

SEQ ID NO: 1618 - protein, 36 aa, Artificial Sequence
  Computer-generated peptide variant
RLRLWKRWLRLFRHCPPAARWKATAQAGRILDRVAM

SEQ ID NO: 1619 - protein, 42 aa, Artificial Sequence
  Computer-generated peptide variant
RWRLFRRLLRLMHPLRQLSKKMYATLLPGRADKRNKQAFWLL

SEQ ID NO: 1620 - protein, 41 aa, Artificial Sequence
  Computer-generated peptide variant
WMKIIRRWWRFLKRTLLTKSLRALRSAKRHLLAPYLLICSR

SEQ ID NO: 1621 - protein, 38 aa, Artificial Sequence
  Computer-generated peptide variant
FLRLLKKFYRRFKHLYARPTIAIRLLACIRLSWLAKKF

SEQ ID NO: 1622 - protein, 32 aa, Artificial Sequence
  Computer-generated peptide variant
KLRLLHRYFKRYKRLKLGAKLALDLQRGLRKM

SEQ ID NO: 1623 - protein, 36 aa, Artificial Sequence
  Computer-generated peptide variant
WMRLLPRWLRKLRRAGLWRQKAARGYSMCRMALRHR

SEQ ID NO: 1624 - protein, 26 aa, Artificial Sequence
  Computer-generated peptide variant
FMRFLCKLWRLLKTAKKKVLIARAEF

SEQ ID NO: 1625 - protein, 56 aa, Artificial Sequence
  Computer-generated peptide variant
WIKYLRKLLKRIRKCANGQLLCPKSVMMAHRKRYAFWPRGLKYLALAKKQRAIKTI

SEQ ID NO: 1626 - protein, 20 aa, Artificial Sequence
  Computer-generated peptide variant
FFRWLNKWLKLFRRASYRAH

SEQ ID NO: 1627 - protein, 89 aa, Artificial Sequence
  Computer-generated peptide variant
LYRFLCKIFKFWKKNAFPRTRKRMKCTADMYYRKPTMALLKAKRKLMFPKLERRALLQRPNLRPDLLLVIMLLVAKNEEMKKVALKRRC

SEQ ID NO: 1628 - protein, 33 aa, Artificial Sequence
  Computer-generated peptide variant
LLRLFSRLFRKWKKINQFLRTMHRRLLRLHYCL

SEQ ID NO: 1629 - protein, 74 aa, Artificial Sequence
  Computer-generated peptide variant
LFRLWCRMLRRLCRLHISKRAATYLMMGEHAAQQLDDIKSHFSRKRARRPATARWALKARAFLQNKKFSMLKLR

SEQ ID NO: 1630 - protein, 85 aa, Artificial Sequence
  Computer-generated peptide variant
KIRMLRRLFRRFKRDRCPFLKLHAGLARDKRHEDQTWKATFLRKRFVVKLLKGADAAEASMADAKLKVLKEFFAKLSGAGRRWLC

SEQ ID NO: 1631 - protein, 27 aa, Artificial Sequence
  Computer-generated peptide variant
LYKFLKRWIRKFPKSLLIATARARAQL

SEQ ID NO: 1632 - protein, 30 aa, Artificial Sequence
  Computer-generated peptide variant
LWKLWNRLWKKYHQWAKKRAMLAFAKNIRC

SEQ ID NO: 1633 - protein, 31 aa, Artificial Sequence
  Computer-generated peptide variant
YMKMLRKLLKKLKRKAYSLRGTLATKQLKWV

SEQ ID NO: 1634 - protein, 58 aa, Artificial Sequence
  Computer-generated peptide variant
KLKLFTKIFKMLKCMWTKAAKYLRANGIRGNAKARAHGLGGAAHRQKALLIAYENKNA

SEQ ID NO: 1635 - protein, 33 aa, Artificial Sequence
  Computer-generated peptide variant
KFRWMRKFFRRFKRAMYPALLKKHKACSLYAAG

SEQ ID NO: 1636 - protein, 25 aa, Artificial Sequence
  Computer-generated peptide variant
RFRYISRLYRRIQTMRSAALAKLLP

SEQ ID NO: 1637 - protein, 72 aa, Artificial Sequence
  Computer-generated peptide variant
RYRYYRKLWRRYKRLVSRAKGRSRNLGLTAAAGVCLKMSNVAWDAHLFAIPALRWRCARPKAARKDRPSAWL

SEQ ID NO: 1638 - protein, 43 aa, Artificial Sequence
  Computer-generated peptide variant
KLKLLKRLWRFYQKLWAKLCDHVLKGVPKLEYASLQKWVKHAL

SEQ ID NO: 1639 - protein, 23 aa, Artificial Sequence
  Computer-generated peptide variant
KLRYLNRFYKMLRQRAKTLATID

SEQ ID NO: 1640 - protein, 20 aa, Artificial Sequence
  Computer-generated peptide variant
RFKLISKWLKLFTRECARLR

SEQ ID NO: 1641 - protein, 75 aa, Artificial Sequence
  Computer-generated peptide variant
KLRMFKKILKKLQSKNVYKLLAYLPRRWQLSAKKTLKLHRRAMEGFWLARKWRKRANQRADYKWFRLLHWAHWQW

SEQ ID NO: 1642 - protein, 26 aa, Artificial Sequence
  Computer-generated peptide variant
RLKLMPKLFRKLRTATNLAWNGVLNK

SEQ ID NO: 1643 - protein, 49 aa, Artificial Sequence
  Computer-generated peptide variant
LMKLIRRFYKRLKRCHFTWWLTNKLLRNRKMFKNRRHELCARDCAAAAM

SEQ ID NO: 1644 - protein, 81 aa, Artificial Sequence
  Computer-generated peptide variant
KLRMLRKLFRRMKKRRSSKAGMRWKKLYLEHRLMSLVAKVAQANLRPEYLKACHLFLKCHASRNIQMRHGKAGRASRKWNR

SEQ ID NO: 1645 - protein, 36 aa, Artificial Sequence
  Computer-generated peptide variant
WFKLLPKLFKLLKQAHYKLWGLLATHRTKMWDKDKA

SEQ ID NO: 1646 - protein, 41 aa, Artificial Sequence
  Computer-generated peptide variant
KMKYFKRYMKRLRQAYLLFALQSRHLPLARHMLMVKAWLRA

SEQ ID NO: 1647 - protein, 43 aa, Artificial Sequence
  Computer-generated peptide variant
FYKLFNKLLKRIRRWPLSHALIKLAAYKLRCLKAKQTCVAVHR

SEQ ID NO: 1648 - protein, 38 aa, Artificial Sequence
  Computer-generated peptide variant
RWRWIKRLIKLWQKLKQATAWAKPRALNEKCSKNRNHL

SEQ ID NO: 1649 - protein, 43 aa, Artificial Sequence
  Computer-generated peptide variant
KFKLFKKLLRRITKWRFSLWPKLTPLLRAKIRYAPFAGVKFKM

SEQ ID NO: 1650 - protein, 23 aa, Artificial Sequence
  Computer-generated peptide variant
RFRLIHRYLKLFNRACRFAAVIK

SEQ ID NO: 1651 - protein, 65 aa, Artificial Sequence
  Computer-generated peptide variant
FLRWFKRYYRKFKNTEHKLRRIAILDLEKWWFMARRKKKLAAGLKFKSIALHRIRVKLSIRACWA

SEQ ID NO: 1652 - protein, 25 aa, Artificial Sequence
  Computer-generated peptide variant
KLRLLSKLIKKIKHFMMQLACARKF

SEQ ID NO: 1653 - protein, 73 aa, Artificial Sequence
  Computer-generated peptide variant
KYRFLKRFYRKLKKMAVWLKCLRRYFLKWAAKALMLTASKRCQKVKARGANCRRMARHRSQFAAMKDNLTAPK

SEQ ID NO: 1654 - protein, 94 aa, Artificial Sequence
  Computer-generated peptide variant
KLRLLRRWLKRLSHLIKLAYKRRKTKRCVRCCRTLRRHKDRLWRGCRFLQKAQVAAAAAHKKAQGKREYQRCLLPTYALYFLKDRKKKLACKRI

SEQ ID NO: 1655 - protein, 41 aa, Artificial Sequence
  Computer-generated peptide variant
YIRYLRRILRKLTRKASLRKLYKADYTLQFHAASMLLLRFT

SEQ ID NO: 1656 - protein, 32 aa, Artificial Sequence
  Computer-generated peptide variant
RFKLLQKLMKFIKNFFGLPRDKLHTQKLLRKA

SEQ ID NO: 1657 - protein, 25 aa, Artificial Sequence
  Computer-generated peptide variant
KLKYFNKLLKFWCSLLRKRTCRENL

SEQ ID NO: 1658 - protein, 32 aa, Artificial Sequence
  Computer-generated peptide variant
RWRIIRRWFRRMRSRNGELLALLNAALRRPRL

SEQ ID NO: 1659 - protein, 47 aa, Artificial Sequence
  Computer-generated peptide variant
KLKFIRKYYKLLKKIKNQRWFGRKKRMAAMKRYLAAWEAALALKEGN

SEQ ID NO: 1660 - protein, 47 aa, Artificial Sequence
  Computer-generated peptide variant
KFKLYKKLFKWLSHRALRWKDRLKAASAPFFWRNAYYKKTWNTLLLF

SEQ ID NO: 1661 - protein, 45 aa, Artificial Sequence
  Computer-generated peptide variant
RFRFLKKLLKFYRPPALKAQKLNLKADMAPICVLKRLLYWNYACT

SEQ ID NO: 1662 - protein, 28 aa, Artificial Sequence
  Computer-generated peptide variant
LYKWLRRWLKRWTHLRMRILTRRAIPAP

SEQ ID NO: 1663 - protein, 31 aa, Artificial Sequence
  Computer-generated peptide variant
MLKYWHKFMKLWCRKEQAALMLDKRLLKLLM

SEQ ID NO: 1664 - protein, 48 aa, Artificial Sequence
  Computer-generated peptide variant
FLRLIRKLLRLWPSHIAAADRKRLKQGGAIHRRCTKLRKWCIRALVLA

SEQ ID NO: 1665 - protein, 60 aa, Artificial Sequence
  Computer-generated peptide variant
YLRFLKRMYKFLRKLAGLVYGNLLRGLIKQKAVLRWPYHKHDREKAPKGTKRHAAAAYLR

SEQ ID NO: 1666 - protein, 20 aa, Artificial Sequence
  Computer-generated peptide variant
FFKLLRKLWKWFTRAAPKAA

SEQ ID NO: 1667 - protein, 20 aa, Artificial Sequence
  Computer-generated peptide variant
RLKLWKKIFKLIHSARELKY

SEQ ID NO: 1668 - protein, 30 aa, Artificial Sequence
  Computer-generated peptide variant
RYRYYHKLLKFLCKIWRKKHALCKAACKFC

SEQ ID NO: 1669 - protein, 73 aa, Artificial Sequence
  Computer-generated peptide variant
RWRYMRKILRKFKKPKVLKCMRLLQTLVHNYKAKLHARLDTGARAFWKAAEKSAAICPFLLKRNYRKKAKKAK

SEQ ID NO: 1670 - protein, 73 aa, Artificial Sequence
  Computer-generated peptide variant
RLKILSRLIKWLKKAARRKPEAYALWPAKKGWWWDYQRWLAMLALILCADEAWLVRVRTDARSRIFKKKCALW

SEQ ID NO: 1671 - protein, 23 aa, Artificial Sequence
  Computer-generated peptide variant
KYKFLKKLLKILRRYQLRKLLVI

SEQ ID NO: 1672 - protein, 40 aa, Artificial Sequence
  Computer-generated peptide variant
YYKLWRRFIRKYPKLPRRDKAHAERQIKRAWLKTGLATIL

SEQ ID NO: 1673 - protein, 64 aa, Artificial Sequence
  Computer-generated peptide variant
KMKLLKRFLKKMPRPKARADKGGWAESGLKARAMRLLACAYGCMPLLKAKKVRKRYQCRIQLAI

SEQ ID NO: 1674 - protein, 53 aa, Artificial Sequence
  Computer-generated peptide variant
FIRLLRRFFRLWRKKRLATAQGWSKMRVLELNECARLKRRQKCKRKAALLLLK

SEQ ID NO: 1675 - protein, 42 aa, Artificial Sequence
  Computer-generated peptide variant
RLRMIKRLMRKWPKRQARIHGLALAALEDLNFYALNFIHLRR

SEQ ID NO: 1676 - protein, 57 aa, Artificial Sequence
  Computer-generated peptide variant
YFRLWRKLYRKIKKFELKTQRKCHTRAVVAFLRRAAKNIQLAADLRAKLQGFFHAIK

SEQ ID NO: 1677 - protein, 98 aa, Artificial Sequence
  Computer-generated peptide variant
RFKFFHRMLKKMCRRLLRYGRLRKLLAQKVAIRCMLLLVLSYQRAAMDLAWKKDAVKALFEMARPRLKRNSMRLLKPQVKRRLLYAPVMVRIAAKVYY

SEQ ID NO: 1678 - protein, 62 aa, Artificial Sequence
  Computer-generated peptide variant
KLRMWSKFIRIYCRARLFRKRFDLYAKRAARALVCADAFCAILPRVLRMQCRASLKLEAKLA

SEQ ID NO: 1679 - protein, 29 aa, Artificial Sequence
  Computer-generated peptide variant
WLRWIRKLLRKIRKDPYAHTLLKLNLFRA

SEQ ID NO: 1680 - protein, 85 aa, Artificial Sequence
  Computer-generated peptide variant
RFRMLSRLFRRMKRRALIKAERKAALHRMRRLDRAFKRNRVPAKMIDNIKNESGNCPAWPALNLDTARKRKPLYRALAAMSWLLR

SEQ ID NO: 1681 - protein, 29 aa, Artificial Sequence
  Computer-generated peptide variant
ILKYLSKWMKWFTKELLDQNRARKRAKHA

SEQ ID NO: 1682 - protein, 51 aa, Artificial Sequence
  Computer-generated peptide variant
RYRLLKKFMRRYRRKNDAPSYLWHKWQIAALLEARMRMRALCMAPLKRKIN

SEQ ID NO: 1683 - protein, 30 aa, Artificial Sequence
  Computer-generated peptide variant
RYRLWRRIYKFLRRRFWHHWTLLKRHLEAA

SEQ ID NO: 1684 - protein, 26 aa, Artificial Sequence
  Computer-generated peptide variant
LLRFLKKLIKRLRRLMHRCLLTNRLL

SEQ ID NO: 1685 - protein, 28 aa, Artificial Sequence
  Computer-generated peptide variant
MLKFLRKLLKFFSRNALHLKKFKFRRAM

SEQ ID NO: 1686 - protein, 42 aa, Artificial Sequence
  Computer-generated peptide variant
KLKYFQKFIKWLSRLKKARMKLLTCLEFEQLLKAPACHSLRR

SEQ ID NO: 1687 - protein, 57 aa, Artificial Sequence
  Computer-generated peptide variant
RLKWFKKLLKKINHAVTKRKARLWAVAATALALARQRRKIRDPHYACLKHLAARQAL

SEQ ID NO: 1688 - protein, 33 aa, Artificial Sequence
  Computer-generated peptide variant
FLRLFKKFLRKLSRADFTLLQKRIALMRHKCNL

SEQ ID NO: 1689 - protein, 78 aa, Artificial Sequence
  Computer-generated peptide variant
LLRYLKRYMKKMTRAKRKKRLRQKQKQRIMLKYALGDWFILTKTDATLMKARPSIWRWKRSRKNRGDAWHRALNLALA

SEQ ID NO: 1690 - protein, 47 aa, Artificial Sequence
  Computer-generated peptide variant
KIKFWCKFLRKLSKHLKRILALTLLQKNAAEAMKNCQDARNSKGRAH

SEQ ID NO: 1691 - protein, 31 aa, Artificial Sequence
  Computer-generated peptide variant
LIRLLRRLFKLLRPTIAKRPKDRRVKVEASL

SEQ ID NO: 1692 - protein, 61 aa, Artificial Sequence
  Computer-generated peptide variant
LMKLLRRLIKWIKKKHKHILWKKNKAKRRALEARGAGCKSNIAFKYWCRLVHRNAKLLRHA

SEQ ID NO: 1693 - protein, 70 aa, Artificial Sequence
  Computer-generated peptide variant
FLRFICRFFRLLQKRMIHMNLSTYAKHAKGCCRRKLRQYLKLLVQKLCLKYALLRRALDFMLKKKNKLLS

SEQ ID NO: 1694 - protein, 25 aa, Artificial Sequence
  Computer-generated peptide variant
FFKLLHRFLRLLSRTWRSRLKATRS

SEQ ID NO: 1695 - protein, 74 aa, Artificial Sequence
  Computer-generated peptide variant
KLKLLRKFLRFFHKLQKSAIKKKFENRTHFAIKIYRLMPRRGMPRQRIKVAAARREKRAYVCCRADALLDLMKE

SEQ ID NO: 1696 - protein, 46 aa, Artificial Sequence
  Computer-generated peptide variant
KLKWIKRFLKRLRQARGAAPKCWRLFRAFRASLQKCEVAPTMRKEL

SEQ ID NO: 1697 - protein, 20 aa, Artificial Sequence
  Computer-generated peptide variant
RLKLLSKWFRRLRPLKWGAL

SEQ ID NO: 1698 - protein, 52 aa, Artificial Sequence
  Computer-generated peptide variant
IMKWFRKIMRMLKRLLLWPFRGSLLHNRHRGREAFRVALRFLAKLMCLLHLA

SEQ ID NO: 1699 - protein, 24 aa, Artificial Sequence
  Computer-generated peptide variant
KLRILKKFLRWFHRRLAAKEFFAW

SEQ ID NO: 1700 - protein, 48 aa, Artificial Sequence
  Computer-generated peptide variant
RIRFWTKMLKMYRKYRLRAYRSLWARFYLRFRAKNIAAAWLMRGQRKL

SEQ ID NO: 1701 - protein, 81 aa, Artificial Sequence
  Computer-generated peptide variant
KLKWYRRLFRRLHQRKKFKCRLKLAFAQAAKLFLCAGGTRRYSLALMNKLNRKRDVRMPWRLVDGIAWSPLAHWRINKKAR

SEQ ID NO: 1702 - protein, 27 aa, Artificial Sequence
  Computer-generated peptide variant
YYKLWCKLIRRLSKKMWFEALLIARFK

SEQ ID NO: 1703 - protein, 95 aa, Artificial Sequence
  Computer-generated peptide variant
LIRMFKKFMRMYKNRNTRAMKLLLKKSIELGAFRGLYLLYPDALAGDLAWMVMLVYHARRRASRATRWKGAPTLAKACRKAIIPLALAACKLKRG

SEQ ID NO: 1704 - protein, 49 aa, Artificial Sequence
  Computer-generated peptide variant
LFRIYNKFFRKLKTAEARLLKAKLLRLIAVSKARLKRQWNLAAITELRK

SEQ ID NO: 1705 - protein, 46 aa, Artificial Sequence
  Computer-generated peptide variant
KLRMIKKIYRRLSKLNKLSRQRARIYLAHANRHNYLILNDARTIRR

SEQ ID NO: 1706 - protein, 29 aa, Artificial Sequence
  Computer-generated peptide variant
RLKLFRKLMRLFKRIRMIDMKNGLPSLYL

SEQ ID NO: 1707 - protein, 25 aa, Artificial Sequence
  Computer-generated peptide variant
MLKFMRKFLRLMRRANLQYANKDAW

SEQ ID NO: 1708 - protein, 76 aa, Artificial Sequence
  Computer-generated peptide variant
YLRFFRKIYRRIRKLAPLSMALTERLDPFLLWFFRRQKRDKLCKTKIKPAHRIKRRAFRLTALSVLKKQAFDKLLM

SEQ ID NO: 1709 - protein, 27 aa, Artificial Sequence
  Computer-generated peptide variant
RLKLMKKFMKLWKTQRKGAGTTVAAAI

SEQ ID NO: 1710 - protein, 24 aa, Artificial Sequence
  Computer-generated peptide variant
WMRLLRKYLKRLRKKHADDTFWAL

SEQ ID NO: 1711 - protein, 73 aa, Artificial Sequence
  Computer-generated peptide variant
KMKMLRKFYRLIKKKASHPSDASGKILASRYDLCAIRMDTKLWLKAQRKKYERNKSRPKAKACRRLALQLADQ

SEQ ID NO: 1712 - protein, 41 aa, Artificial Sequence
  Computer-generated peptide variant
LFRLMRKWLRKFRRHATDAKIKRYTCKALMHRASKANATMG

SEQ ID NO: 1713 - protein, 58 aa, Artificial Sequence
  Computer-generated peptide variant
RWRFLPRLLRRLKREVGKRLHPLYKARTLFKSMGDRRMAGLLARDAYRLNIMKWYGKI

SEQ ID NO: 1714 - protein, 46 aa, Artificial Sequence
  Computer-generated peptide variant
RFRFYKRFWKLLHCLYFKNHMAKANLLAAECAAVAHKRRRDRLAWK

SEQ ID NO: 1715 - protein, 38 aa, Artificial Sequence
  Computer-generated peptide variant
KIRIIPRILKLYRNRQPKRKLLAAEAKAHPIKAFYAEL

SEQ ID NO: 1716 - protein, 24 aa, Artificial Sequence
  Computer-generated peptide variant
RFRFFKKYLKYLKHLTRLKAMAMP

SEQ ID NO: 1717 - protein, 27 aa, Artificial Sequence
  Computer-generated peptide variant
KLKWLKKIFKFLQRKAACLHKRFLTLK

SEQ ID NO: 1718 - protein, 39 aa, Artificial Sequence
  Computer-generated peptide variant
RWKIFRRMLRMLKRLDIAAKSSLQYACPARAKERTQHAK

SEQ ID NO: 1719 - protein, 34 aa, Artificial Sequence
  Computer-generated peptide variant
YLKILHRFLKKLSKAKRRMRKMLALFKDLKLDLE

SEQ ID NO: 1720 - protein, 24 aa, Artificial Sequence
  Computer-generated peptide variant
KLKYLRKILKRIHSKLAVLIFQTK

SEQ ID NO: 1721 - protein, 70 aa, Artificial Sequence
  Computer-generated peptide variant
RFKLLQRWWRKYPKRACSYWKVLLKLKRFANYLLMLKPKLAIIRLLCAKLNYDRPRKDRNFKVRGFAKEV

SEQ ID NO: 1722 - protein, 33 aa, Artificial Sequence
  Computer-generated peptide variant
RWKMFRKFLRRWRKLKAARLRAFLCLKHAASPK

SEQ ID NO: 1723 - protein, 40 aa, Artificial Sequence
  Computer-generated peptide variant
KFKLLRRLYKLFHKMVRPRIEHKADAHLNARAACSAEKKK

SEQ ID NO: 1724 - protein, 29 aa, Artificial Sequence
  Computer-generated peptide variant
WLRLYRRLLKKWQQKDKLAPTCLKCELGK

SEQ ID NO: 1725 - protein, 78 aa, Artificial Sequence
  Computer-generated peptide variant
KLRLFHKMIRRYKRLAFHALIIKEIGGTKLAGNKPARAKLKRLWTASKAQATLLLCEKLQLNLVCNKKRGCFFLLRKL

SEQ ID NO: 1726 - protein, 63 aa, Artificial Sequence
  Computer-generated peptide variant
RIRLFQRLLKLLRPKYYCKWPECRALIELDFRKRDPRRRALRAKRHRNEARAASLADRVMRKG

SEQ ID NO: 1727 - protein, 21 aa, Artificial Sequence
  Computer-generated peptide variant
ILRYLKKFFRKLRRYLLEVAG

SEQ ID NO: 1728 - protein, 48 aa, Artificial Sequence
  Computer-generated peptide variant
IWKYMKRYFRRINRYANALGLLIAYKLLRARAEFAYMKAKTLKYKRWD

SEQ ID NO: 1729 - protein, 56 aa, Artificial Sequence
  Computer-generated peptide variant
RIKLFTRMFKLIKKKWMKTLVHMRLVTRRKLMQCWALCLKQKRRIKPATAEALCAK

SEQ ID NO: 1730 - protein, 29 aa, Artificial Sequence
  Computer-generated peptide variant
LLKLLRKILRFFPRAQGDLWGERYRCHRL

SEQ ID NO: 1731 - protein, 37 aa, Artificial Sequence
  Computer-generated peptide variant
MYRMLRRLMRKFKPDYFNSMIKLQPLARLRLRARKLI

SEQ ID NO: 1732 - protein, 60 aa, Artificial Sequence
  Computer-generated peptide variant
FFRIYKKWLRRLQKLLLAKAANIKMERARKMNELTRPFLKRPLKMCLRADIQRKVQPPQL

SEQ ID NO: 1733 - protein, 37 aa, Artificial Sequence
  Computer-generated peptide variant
RLRLFHKFLKKYKRRDKCAQLFLRVHLGFAPVKRPAM

SEQ ID NO: 1734 - protein, 37 aa, Artificial Sequence
  Computer-generated peptide variant
WMRLLRKLIKYYPRAIHSPIAQKGAKAAKLLSFKARI

SEQ ID NO: 1735 - protein, 21 aa, Artificial Sequence
  Computer-generated peptide variant
KYRLITRYFRLYRKKALTLEA

SEQ ID NO: 1736 - protein, 48 aa, Artificial Sequence
  Computer-generated peptide variant
RLRLFRRLFRKLQRLLYLDHRKSAQLTVASDAMICRRSKGNSRIPRAR

SEQ ID NO: 1737 - protein, 27 aa, Artificial Sequence
  Computer-generated peptide variant
RLKFYRRFIRRLQTLKAVANAKREGEA

SEQ ID NO: 1738 - protein, 76 aa, Artificial Sequence
  Computer-generated peptide variant
FLKIMCKLLRLYKRGLLNLAYCHFRSRWRWHGCKARTRRACWRKISSLLRLAWVALHTAEREILWRKACLTRDRRA

SEQ ID NO: 1739 - protein, 30 aa, Artificial Sequence
  Computer-generated peptide variant
FLKLWKRFYRRWSKKRLPAGADASARRHML

SEQ ID NO: 1740 - protein, 36 aa, Artificial Sequence
  Computer-generated peptide variant
RIRLIRRWWRKLRRHRALTTPLAICWLKLSAFYSAK

SEQ ID NO: 1741 - protein, 70 aa, Artificial Sequence
  Computer-generated peptide variant
KFRLLCRLYKFLKPARIKRCLNSPAGAIRKARPPLINKTRLLKWSCRLRKDLAHYAAAKKASNAELVKKN

SEQ ID NO: 1742 - protein, 37 aa, Artificial Sequence
  Computer-generated peptide variant
RLKWMKKLFRKFKKNGLEHSRVKSVLAAWKCNADALA

SEQ ID NO: 1743 - protein, 22 aa, Artificial Sequence
  Computer-generated peptide variant
KFRMLRKLMRFYRSRAKAALEL

SEQ ID NO: 1744 - protein, 64 aa, Artificial Sequence
  Computer-generated peptide variant
KFKLLRKLLKKYKTFAHVAAKGEGWRKLAAKHVRRARSDFSRRKAAIKFAEKQLLKAIKILKSD

SEQ ID NO: 1745 - protein, 43 aa, Artificial Sequence
  Computer-generated peptide variant
LMKILTKFMRRFRRRRKRYKIHAFARYADAAARCQRLPLMACR

SEQ ID NO: 1746 - protein, 57 aa, Artificial Sequence
  Computer-generated peptide variant
RLRFLRRFLKRLKRCLTIPLSAAADKKKRLLRRDKLDFHVANRLLYCIPKCRVAHAG

SEQ ID NO: 1747 - protein, 21 aa, Artificial Sequence
  Computer-generated peptide variant
LLKWLRRFMKKYKRALKAATK

SEQ ID NO: 1748 - protein, 52 aa, Artificial Sequence
  Computer-generated peptide variant
WLKLLTRWIKLLRPKICRDDHKTPLKSRLNAKWLAAEKRRAQAPKMREARFA

SEQ ID NO: 1749 - protein, 33 aa, Artificial Sequence
  Computer-generated peptide variant
RLRFLKRLLKRIHTILLLFQLNIKIGRLTASAR

SEQ ID NO: 1750 - protein, 80 aa, Artificial Sequence
  Computer-generated peptide variant
KFKFLRRYFKRYKHLKRLGYLRAKLRLTKLASYCCFYATFWKCRMAPKARRAGHTRKMWLRDSKFRILRQKAMWLASFLY

SEQ ID NO: 1751 - protein, 22 aa, Artificial Sequence
  Computer-generated peptide variant
FLRYYSKLYKKITKAKARALAP

SEQ ID NO: 1752 - protein, 28 aa, Artificial Sequence
  Computer-generated peptide variant
KMKLYKKWWRKLRHEALLQACQKNAPPL

SEQ ID NO: 1753 - protein, 48 aa, Artificial Sequence
  Computer-generated peptide variant
LLRWLKRYIKKLSRTAEKHMRAKLPAKWTELGLREAYLLICANLNRWL

SEQ ID NO: 1754 - protein, 46 aa, Artificial Sequence
  Computer-generated peptide variant
WLKMLHKFLKKLRKYWRKKLACKTSKLAKRQKSGEMMYGLRAMFEL

SEQ ID NO: 1755 - protein, 20 aa, Artificial Sequence
  Computer-generated peptide variant
LLRLMKKMFRRICCLLKHAL

SEQ ID NO: 1756 - protein, 26 aa, Artificial Sequence
  Computer-generated peptide variant
MLKMLKRWYRRLKTYAEKGTALTAAP

SEQ ID NO: 1757 - protein, 44 aa, Artificial Sequence
  Computer-generated peptide variant
FMKLLRRYFKLLQNLQALSSKADMWARGRKRIILASFKKAARNS

SEQ ID NO: 1758 - protein, 21 aa, Artificial Sequence
  Computer-generated peptide variant
KYKFFCRWFKLWRRAPRALLN

SEQ ID NO: 1759 - protein, 20 aa, Artificial Sequence
  Computer-generated peptide variant
KLRYYRRLMKLLPKFAHLYT

SEQ ID NO: 1760 - protein, 90 aa, Artificial Sequence
  Computer-generated peptide variant
KFKLIRKLWKRLKRCGRQRPRIYLQPDPLKRILAILACLSTNMALLDLNAGHKLKKSMGKAAKRQNRALLKLVLNECLAEELLLRATCVQ

SEQ ID NO: 1761 - protein, 27 aa, Artificial Sequence
  Computer-generated peptide variant
LYKMLTKLFRFLSPKLEKRARLMGFKP

SEQ ID NO: 1762 - protein, 50 aa, Artificial Sequence
  Computer-generated peptide variant
KIRMMTKFLRFWQSPSFKPCLVLLARYLAKRALQLKDRGLKLRRLKKLRC

SEQ ID NO: 1763 - protein, 20 aa, Artificial Sequence
  Computer-generated peptide variant
RIKWFKRLIKLLPKYCDKAL

SEQ ID NO: 1764 - protein, 21 aa, Artificial Sequence
  Computer-generated peptide variant
ILRLFNKLLRYFPPLKGWKKR

SEQ ID NO: 1765 - protein, 27 aa, Artificial Sequence
  Computer-generated peptide variant
LMRFFKRYIKKLRKARKAAGAYLRSFA

SEQ ID NO: 1766 - protein, 33 aa, Artificial Sequence
  Computer-generated peptide variant
RLKLLCKLFKKLRKGEGPKAQLLAKLLLKDCLN

SEQ ID NO: 1767 - protein, 23 aa, Artificial Sequence
  Computer-generated peptide variant
RLRFLKRMLKFLKSIHTILTLYR

SEQ ID NO: 1768 - protein, 69 aa, Artificial Sequence
  Computer-generated peptide variant
LLKFIRRFIKRLQKQQGMRQGCLLTKKAYSMKLPFHTSARARLLAPLLKDASKARCVDAPLKKRVLIKR

SEQ ID NO: 1769 - protein, 30 aa, Artificial Sequence
  Computer-generated peptide variant
RLRMLKKLMKKLPPMQLPALKKRSLKQNLL

SEQ ID NO: 1770 - protein, 63 aa, Artificial Sequence
  Computer-generated peptide variant
KWRWFKKLYKFFHPPQTRHKAGKKMARAWKPRKKLLLKLLKSHPARMMLSLRLLGGLKIKAPI

SEQ ID NO: 1771 - protein, 37 aa, Artificial Sequence
  Computer-generated peptide variant
RLKYMRRFLRFLKKLRALMQAPNMLKGDYARTWPLRY

SEQ ID NO: 1772 - protein, 28 aa, Artificial Sequence
  Computer-generated peptide variant
RYRFFKRLLRFYSTLLKRMAAFAQFSLA

SEQ ID NO: 1773 - protein, 36 aa, Artificial Sequence
  Computer-generated peptide variant
RMKILKRLMKLIRRWAMMLHYALAPRVKRHTNLDNR

SEQ ID NO: 1774 - protein, 41 aa, Artificial Sequence
  Computer-generated peptide variant
FLKLIRKFFRKLRRSALAAFLARKAKDTHTVQMMECRREAD

SEQ ID NO: 1775 - protein, 76 aa, Artificial Sequence
  Computer-generated peptide variant
KIKMYKKMLRIFKRALFCLTMIIRCLLRKDAHIAPYMAQLRRARWAYKDLLFPLRGRRTLSATDLKRKKRYAHRPA

SEQ ID NO: 1776 - protein, 33 aa, Artificial Sequence
  Computer-generated peptide variant
LYKFWKKFLRKWKRALSVLRQLARLPTKLRKSD

SEQ ID NO: 1777 - protein, 22 aa, Artificial Sequence
  Computer-generated peptide variant
KLKLMHKLFRWWKKEIKLPAAE

SEQ ID NO: 1778 - protein, 74 aa, Artificial Sequence
  Computer-generated peptide variant
KFKFMQKMFKRLNPANNLLIYKAIGLKVRLHKRALKNIKWKLVMYCDCKTRCRALCVKRRAGVRAAARASTKLR

SEQ ID NO: 1779 - protein, 25 aa, Artificial Sequence
  Computer-generated peptide variant
RLKMFKRMYRKFRNALKLLMDYRAL

SEQ ID NO: 1780 - protein, 41 aa, Artificial Sequence
  Computer-generated peptide variant
LLRWIRRWLRLWQKGLLKLASKVHKCKQRYGAKCFFMKAQA

SEQ ID NO: 1781 - protein, 46 aa, Artificial Sequence
  Computer-generated peptide variant
KWRYWKKLLRFLRSWHVLKWKHALVRKNQLYDWAYQRARQRNAAAA

SEQ ID NO: 1782 - protein, 21 aa, Artificial Sequence
  Computer-generated peptide variant
RLKWLCRLLKRFSPVYLLTKT

SEQ ID NO: 1783 - protein, 34 aa, Artificial Sequence
  Computer-generated peptide variant
KFKLLQKFLRKLCKAQVKAPACNLQKLRIAMTWL

SEQ ID NO: 1784 - protein, 38 aa, Artificial Sequence
  Computer-generated peptide variant
IWRLLRKFLKLMSRASTKYLPLLAMKVKLGHLLTHMKC

SEQ ID NO: 1785 - protein, 45 aa, Artificial Sequence
  Computer-generated peptide variant
LFKWWKKLLKYLTQRAAFQKRRMACLQSPTRARLRALVTRKCGAV

SEQ ID NO: 1786 - protein, 43 aa, Artificial Sequence
  Computer-generated peptide variant
KLKYLKRYYRKLCKLAWLCGRGLMLTRAAGQKSNMLRCRMAAK

SEQ ID NO: 1787 - protein, 50 aa, Artificial Sequence
  Computer-generated peptide variant
LWKFFCRFIRLYRRKRNWKARLKAKQMKLALTAQLQKEHRLQLWKYMKLH

SEQ ID NO: 1788 - protein, 23 aa, Artificial Sequence
  Computer-generated peptide variant
LFKLLRRMLKKFQKLAPFVKMCE

SEQ ID NO: 1789 - protein, 65 aa, Artificial Sequence
  Computer-generated peptide variant
ILRLLRRIYKRMCKMMKAAKRAKASRAKCTASKEQLSNRARLTAIWLDVHYARNSLRKSDKRLKK

SEQ ID NO: 1790 - protein, 58 aa, Artificial Sequence
  Computer-generated peptide variant
WLKLLKRYFRKFRKCQWLLGKWNASCNQKKLHLPGMTARLEALARSLLKRDDGILGKL

SEQ ID NO: 1791 - protein, 28 aa, Artificial Sequence
  Computer-generated peptide variant
RMRFLKKLLRRLRTGNIKLVHAVYLAWH

SEQ ID NO: 1792 - protein, 26 aa, Artificial Sequence
  Computer-generated peptide variant
KMKMWNRMWRKLKTLAAIRLKGAARW

SEQ ID NO: 1793 - protein, 27 aa, Artificial Sequence
  Computer-generated peptide variant
LYRMLRKLYRRLKNMLRKDLLPVLKEH

SEQ ID NO: 1794 - protein, 49 aa, Artificial Sequence
  Computer-generated peptide variant
LYRMLKKIIKIFKSNAALIWLKAFLVRRAAHLHSMKSLRKFTLRKRKLF

SEQ ID NO: 1795 - protein, 41 aa, Artificial Sequence
  Computer-generated peptide variant
KIKLLRRLFKYYCKRPPLAVRCKVPYRAALAFLRCLLKERR

SEQ ID NO: 1796 - protein, 22 aa, Artificial Sequence
  Computer-generated peptide variant
RWKLWPKMLRRLTKLAASCACR

SEQ ID NO: 1797 - protein, 36 aa, Artificial Sequence
  Computer-generated peptide variant
RFRYWKKMLRRLTKLHWRRLKLMLLCWFRERLIYLC

SEQ ID NO: 1798 - protein, 38 aa, Artificial Sequence
  Computer-generated peptide variant
FLKYLKKFYRRLRQLRQRAWPLHADTCAAHLLRARNPY

SEQ ID NO: 1799 - protein, 61 aa, Artificial Sequence
  Computer-generated peptide variant
KIRMLRRLWRLLRKALKLNFAKYDNQLHRARVKWKLRFQEVLLARRVTKHWGGWRMMHLLM

SEQ ID NO: 1800 - protein, 74 aa, Artificial Sequence
  Computer-generated peptide variant
LIKIIKRWIRLLNNRIKAAFDWAVDHHFLTKMNLAPDRKAHSRRYELDLLAARRRKRIALACLKHWKAQKDPKR

SEQ ID NO: 1801 - protein, 91 aa, Artificial Sequence
  Computer-generated peptide variant
RLRFLKKLIKKFRCAHKWEQLNKLKLCPPKAAGNDNRWLTCRKRRRRDESALYRTYWLMAAVMKMARRAWELALPGLTRMVRLKWAITAAL

SEQ ID NO: 1802 - protein, 28 aa, Artificial Sequence
  Computer-generated peptide variant
KLRFLSKMFRRWKRMTKYHMRLANLAML

SEQ ID NO: 1803 - protein, 20 aa, Artificial Sequence
  Computer-generated peptide variant
RMRLLNRLMRLWSKMPAKLV

SEQ ID NO: 1804 - protein, 72 aa, Artificial Sequence
  Computer-generated peptide variant
YFRIYKKFLKKMRCAALMMRLKSRRKKPLKALAELELKKNHFALLAATVVCKAKWSSFQAFMLWDYELKKTR

SEQ ID NO: 1805 - protein, 80 aa, Artificial Sequence
  Computer-generated peptide variant
FLRFMCRMYRLLQQALRRLDKKRKLPRFKPEPKMAQALWSALRRLAASDMKAHFQLEFCRCLYSKMRILKQGACRGKRAR

SEQ ID NO: 1806 - protein, 58 aa, Artificial Sequence
  Computer-generated peptide variant
KWRFYKKFMRYFTKEYALHYRGATLPKLARKTLARKPPLASKRLQADCMSRRLALVFL

SEQ ID NO: 1807 - protein, 42 aa, Artificial Sequence
  Computer-generated peptide variant
KFRWLNKLYRKWSKPAALLACHERKEWLAASADRLKRRRDLK

SEQ ID NO: 1808 - protein, 88 aa, Artificial Sequence
  Computer-generated peptide variant
RFRFLHKLFRIYSRQARLAAMADYRAVVARRHKPAAARHLRALLLIATKWLTALWKQRALTGNEQRWFFAKFRWCGKNYAKVGAKKKM

SEQ ID NO: 1809 - protein, 59 aa, Artificial Sequence
  Computer-generated peptide variant
WYKFLRRMWKLLNNNVWPGLLCKARARAAKFWRLHIGAKAAKMIMKALCRKPLWRREAV

SEQ ID NO: 1810 - protein, 23 aa, Artificial Sequence
  Computer-generated peptide variant
LLRYLSRFLRLLHRVKAIFDWKY

SEQ ID NO: 1811 - protein, 29 aa, Artificial Sequence
  Computer-generated peptide variant
RIKLWHRLFRMISHRLKKAARAILTEGPA

SEQ ID NO: 1812 - protein, 40 aa, Artificial Sequence
  Computer-generated peptide variant
KFRFIKRYFKKLPKLSWHWAHRARKIRALLGFFLQCAKTK

SEQ ID NO: 1813 - protein, 70 aa, Artificial Sequence
  Computer-generated peptide variant
KFRIWQKLLKLYRRKLYKYYFFHRRRKKNAPFAHKSAAAPKVAYRALARGKLALWAPLYAACKLAILLEP

SEQ ID NO: 1814 - protein, 69 aa, Artificial Sequence
  Computer-generated peptide variant
LLKYLRKLWRKLSKYLHHDGRRCLYHKKWVFARSARPLRLNARRIDDEAFCWMLYLLIKLPCQKRLLRL

SEQ ID NO: 1815 - protein, 56 aa, Artificial Sequence
  Computer-generated peptide variant
KFRIYTKFIRRLRKFLKFYAWESECATAALRRVKSRCDAREYRLTKLKFKAWLARF

SEQ ID NO: 1816 - protein, 20 aa, Artificial Sequence
  Computer-generated peptide variant
KWKMYKKILKMLKSLFHQLL

SEQ ID NO: 1817 - protein, 44 aa, Artificial Sequence
  Computer-generated peptide variant
RMRYIRKLWKLLCRRRNLSWHKKHRGYALHAAPYAVARHVLADL

SEQ ID NO: 1818 - protein, 33 aa, Artificial Sequence
  Computer-generated peptide variant
KMKLWRKLMRKIRSSRPKLLFYQLKEQQRAALE

SEQ ID NO: 1819 - protein, 43 aa, Artificial Sequence
  Computer-generated peptide variant
KWKMLKRLLRFIKCYDKRLWKQATCLDAWKSWLRALKRLAKWL

SEQ ID NO: 1820 - protein, 92 aa, Artificial Sequence
  Computer-generated peptide variant
YFKLMRRLIRYMHRAVAKRISRLLHALQNRIKAKIKQKWLNAKNAALKLMWRHRIKLTKRFRKMATLYMWWLGLLLLISNRANEKNELMAKH

SEQ ID NO: 1821 - protein, 85 aa, Artificial Sequence
  Computer-generated peptide variant
KFRILRKYLKLLSTPAVHEAFKFQKKRAQLASKRRASRKHDGRKLLLRRELWNNQSRTDWHRWLRTKFPFALRRLKNCYAGRMLL

SEQ ID NO: 1822 - protein, 84 aa, Artificial Sequence
  Computer-generated peptide variant
KWKLLKRYMRYYNRLATWNRDRKLIAKMPEMTGAAAVRIFHLLLARYAAALTKKPLAPRIFLAAVKAKKKTTARTAETRKMPRT

SEQ ID NO: 1823 - protein, 65 aa, Artificial Sequence
  Computer-generated peptide variant
LLKMWTRLYRKFKKYRIMKLQDILCLVLDWHWKRRNALYDWHRLFKAEKRKQKAAALMRRCLQPL

SEQ ID NO: 1824 - protein, 27 aa, Artificial Sequence
  Computer-generated peptide variant
KYRLFHRLWKRMPTLVRDAYGLARTAK

SEQ ID NO: 1825 - protein, 43 aa, Artificial Sequence
  Computer-generated peptide variant
KFRLLPRFYRIMKQLKLAAKRKLYQFRAMARYARELTERAWHT

SEQ ID NO: 1826 - protein, 77 aa, Artificial Sequence
  Computer-generated peptide variant
RYRLLCKMLKRLCRLMRYLIRRKIVRMEKKRGDPLKRARAVAPAGGAAALLYIHMMQARICVLKRITKLRTYHAQMA

SEQ ID NO: 1827 - protein, 38 aa, Artificial Sequence
  Computer-generated peptide variant
KFKFFKKLFKLINPLCSKCKAHARLAKRMAVLDILVKL

SEQ ID NO: 1828 - protein, 31 aa, Artificial Sequence
  Computer-generated peptide variant
RLKLLKRILRLWQRTWKFRLRIHSACLYAFD

SEQ ID NO: 1829 - protein, 47 aa, Artificial Sequence
  Computer-generated peptide variant
KLRFYQRWIRKMKRLERLHYRPSDVLRLRAIARIAERLIWAYKLAVA

SEQ ID NO: 1830 - protein, 25 aa, Artificial Sequence
  Computer-generated peptide variant
FLKILKRLFKKFPKKAYYFKAWPTA

SEQ ID NO: 1831 - protein, 33 aa, Artificial Sequence
  Computer-generated peptide variant
LLKYFKKLFKRLRQRAAAKKTKLGGTIHSLYWG

SEQ ID NO: 1832 - protein, 36 aa, Artificial Sequence
  Computer-generated peptide variant
KMRIIQRFFRYLKRQILIALRRGLLFHAKKAANCAA

SEQ ID NO: 1833 - protein, 72 aa, Artificial Sequence
  Computer-generated peptide variant
RFRYFCKLMRLMRKLGANRALKAAARLAYCGRKHAAATIEKHAADRYWLAEGQLLLYYRFMFCFKFDDKKKK

SEQ ID NO: 1834 - protein, 27 aa, Artificial Sequence
  Computer-generated peptide variant
LLRFWRKLIRMFRHRCKSAEASRAGAY

SEQ ID NO: 1835 - protein, 33 aa, Artificial Sequence
  Computer-generated peptide variant
KLRMWRRLFRYLKRKPPAVLMAGADALKANEYF

SEQ ID NO: 1836 - protein, 20 aa, Artificial Sequence
  Computer-generated peptide variant
WFKWLPKLIKFLKHKARLKF

SEQ ID NO: 1837 - protein, 38 aa, Artificial Sequence
  Computer-generated peptide variant
LLRLYHKIIRMFSKHLRYGTIWFRRKEAKWLRALYKLA

SEQ ID NO: 1838 - protein, 55 aa, Artificial Sequence
  Computer-generated peptide variant
KWKIICRLLKKMTPCRCRKARQIAALRLRYDVLRALAEQCGALRARRLKCRLIHL

SEQ ID NO: 1839 - protein, 31 aa, Artificial Sequence
  Computer-generated peptide variant
LFRLYKRLIKRLTQARACMAKARIMALRHKG

SEQ ID NO: 1840 - protein, 57 aa, Artificial Sequence
  Computer-generated peptide variant
WLRFINKFMRKYKNRLLFALYCAETAHGLRDAVRLKANDKRTSWLRKHKKLALSEKK

SEQ ID NO: 1841 - protein, 38 aa, Artificial Sequence
  Computer-generated peptide variant
RLKLLRKLYKRFTRKQQKRRIALHYLQAHEFELRNRAG

SEQ ID NO: 1842 - protein, 35 aa, Artificial Sequence
  Computer-generated peptide variant
FLRLLKKWMRWLRPGALNNARKKYSPSIRLAKRLK

SEQ ID NO: 1843 - protein, 34 aa, Artificial Sequence
  Computer-generated peptide variant
KFRIFKRMFKRLKCELHAWKAKALALRANMLKWL

SEQ ID NO: 1844 - protein, 22 aa, Artificial Sequence
  Computer-generated peptide variant
LLKFFTKLWRLLKKVCPRRAPF

SEQ ID NO: 1845 - protein, 87 aa, Artificial Sequence
  Computer-generated peptide variant
WLRLFKKWMRRMKRAACREQKWMAAKDPANVALALGEKAYHELTETASYRRTDSNLRKKKEPFYRKAIAAWRRKTPSKKRLKLARAL

SEQ ID NO: 1846 - protein, 64 aa, Artificial Sequence
  Computer-generated peptide variant
KLKYMTKLFKKFHTVKKREGKAMNYFLRNLQAAPHRHAVVKRKRRALAAWKLDKAPAKVIHARL

SEQ ID NO: 1847 - protein, 20 aa, Artificial Sequence
  Computer-generated peptide variant
YLRLYTRLFRRMKHRLACLV

SEQ ID NO: 1848 - protein, 45 aa, Artificial Sequence
  Computer-generated peptide variant
FYKYYRKIFKLLKKRTWIKWRLNHARLLIKLKRLMFQAAQRPEAK

SEQ ID NO: 1849 - protein, 54 aa, Artificial Sequence
  Computer-generated peptide variant
RLKLFRRWLKKWRQRALRAMACKTLRTYLLHAAAGQAPTDGAMRMARELTRRRV

SEQ ID NO: 1850 - protein, 52 aa, Artificial Sequence
  Computer-generated peptide variant
KWKFLHKYLKRLKCQLLRTINHANMKLAKTKKPKAGATLRKECRKIERYYLL

SEQ ID NO: 1851 - protein, 40 aa, Artificial Sequence
  Computer-generated peptide variant
KWRFLPRLYRRYRNIKKSARARKRLASLWQAQIPERDILW

SEQ ID NO: 1852 - protein, 53 aa, Artificial Sequence
  Computer-generated peptide variant
WIKIWKRIFKILRKLRKCEALLMDKQKLIALAKKARAYLELKGKLTKRVNAAM

SEQ ID NO: 1853 - protein, 60 aa, Artificial Sequence
  Computer-generated peptide variant
FLRYLRKLLRRLQKLKTKALACGCKGAAWAFEGRKLRKARRLARDNAAFDKWYLLSTWKT

SEQ ID NO: 1854 - protein, 77 aa, Artificial Sequence
  Computer-generated peptide variant
ILRMWKKMWRRWKRLRLGKIDVRAKHLRFEPREELARQTALKRHALRLHRGKSRAMAHLQVGRWIVLALSCGLGLKR

SEQ ID NO: 1855 - protein, 32 aa, Artificial Sequence
  Computer-generated peptide variant
RLKLLRRLYRYWRRYTPALLHRYCQLRSEIKA

SEQ ID NO: 1856 - protein, 31 aa, Artificial Sequence
  Computer-generated peptide variant
FMKILRRLLKMYKRLALRRANMRAWLAQNFG

SEQ ID NO: 1857 - protein, 37 aa, Artificial Sequence
  Computer-generated peptide variant
RFKWICRWFKRLKCHQAKDLRKLTSFARARWKAYALY

SEQ ID NO: 1858 - protein, 39 aa, Artificial Sequence
  Computer-generated peptide variant
IMKLFTKFLRRLRRVPQRMALFLLQLRRRVQRDYASQLR

SEQ ID NO: 1859 - protein, 98 aa, Artificial Sequence
  Computer-generated peptide variant
RLKLIPKLYKKLQTKKKRNAEGNRQEICTQARLVQMALLADLMAKDAIHKLYYAKHWAAKATLRLAARPLIQKALWKTKAQTERLVARMIFKELLLIT

SEQ ID NO: 1860 - protein, 42 aa, Artificial Sequence
  Computer-generated peptide variant
RFKFYRRFFKRMRKGARKAAAFLAWEARAPTCLMALCLRGRT

SEQ ID NO: 1861 - protein, 30 aa, Artificial Sequence
  Computer-generated peptide variant
RYKLWTKLLKMFCHRYLKALLKAGRADKVA

SEQ ID NO: 1862 - protein, 52 aa, Artificial Sequence
  Computer-generated peptide variant
KLKLLRKMWRKFRRCQLKKLQQRCRAFCRLLTLNVVKKYWITYQLAYAEAKA

SEQ ID NO: 1863 - protein, 47 aa, Artificial Sequence
  Computer-generated peptide variant
LLRWFRRLFRKLKKITHAMGMAPQRTLFLNLRKLCAGLWWKDKKSRV

SEQ ID NO: 1864 - protein, 56 aa, Artificial Sequence
  Computer-generated peptide variant
KIRIYKKFFRRLRRLALLLKSCKIKYGAADASASTMLAKTVKRKLKLIKWHLASKS

SEQ ID NO: 1865 - protein, 63 aa, Artificial Sequence
  Computer-generated peptide variant
RFKFIKKILRRLKTMLDKLLAVKHQNHRLKAKTQVWHRQLKQLRKILCARKWGLMKGLCCKAR

SEQ ID NO: 1866 - protein, 78 aa, Artificial Sequence
  Computer-generated peptide variant
RFRLFKKIWKKFKKKKRVLDYTRAARKASELNEKQSLAALGRWWIKDFLLPNKKCLPNQSAHKLRAPKGRRLAALKCR

SEQ ID NO: 1867 - protein, 36 aa, Artificial Sequence
  Computer-generated peptide variant
KIKLLRRFMRLLQKKNAIGALISKFAYAKNGARRRK

SEQ ID NO: 1868 - protein, 28 aa, Artificial Sequence
  Computer-generated peptide variant
RLKLLRKIWKIYRRPCAAGASCAQLNSK

SEQ ID NO: 1869 - protein, 30 aa, Artificial Sequence
  Computer-generated peptide variant
KLRWLSKFMRKWTSMRFKLFLLDKALKKCA

SEQ ID NO: 1870 - protein, 21 aa, Artificial Sequence
  Computer-generated peptide variant
LLRFIRRLFRKWKRELALKHT

SEQ ID NO: 1871 - protein, 27 aa, Artificial Sequence
  Computer-generated peptide variant
RLKMLNRFLRKITKAQAKLMAFLDLRR

SEQ ID NO: 1872 - protein, 47 aa, Artificial Sequence
  Computer-generated peptide variant
RFRLIHRLWKLWKRLIALLQKRLLNKMRAKRIEYLFRHMMKFPLCAR

SEQ ID NO: 1873 - protein, 23 aa, Artificial Sequence
  Computer-generated peptide variant
LLKILKRLLKKLNSGWKCGLRAY

SEQ ID NO: 1874 - protein, 33 aa, Artificial Sequence
  Computer-generated peptide variant
RMRLLKRFLKWYQKLQTRLLKVLRLWAFCIWCK

SEQ ID NO: 1875 - protein, 58 aa, Artificial Sequence
  Computer-generated peptide variant
KLKLWSKFMRYLKCAFCRAQKLLIAKAALAKMAWTFNRQEAARRRHQFQKEVYAARLR

SEQ ID NO: 1876 - protein, 33 aa, Artificial Sequence
  Computer-generated peptide variant
KYRMLSRILRRFQKAKVSCHRWLAKPTKLAVLA

SEQ ID NO: 1877 - protein, 24 aa, Artificial Sequence
  Computer-generated peptide variant
WYKLLCKWLKKMHHLKFRKKQLLA

SEQ ID NO: 1878 - protein, 45 aa, Artificial Sequence
  Computer-generated peptide variant
YLKFWKKILKKFTKVVRILIGLSANRAAAKKANLSAKRTEIKAFR

SEQ ID NO: 1879 - protein, 27 aa, Artificial Sequence
  Computer-generated peptide variant
WLKFLKKLIKWLSKLRAYAHARNEREW

SEQ ID NO: 1880 - protein, 57 aa, Artificial Sequence
  Computer-generated peptide variant
WLRLFHRFIRKLRRMACGKVQVKAFKRYWLLLPKLDRHAHRKRALTAVYKRAAVLWQ

SEQ ID NO: 1881 - protein, 29 aa, Artificial Sequence
  Computer-generated peptide variant
LIKLLRKWYRRIRKVNQYVLCAAHRWAKP

SEQ ID NO: 1882 - protein, 36 aa, Artificial Sequence
  Computer-generated peptide variant
YWKYLKKIYRILRSARYALLAKNPTRKLNALIKKLR

SEQ ID NO: 1883 - protein, 81 aa, Artificial Sequence
  Computer-generated peptide variant
FLKLLKKYFKKFRKLDAKRMKRGLNYKCQRMDPSSLKEVKLKIKLLYDLKWPPSRRAPQIACRTARDRLNDAQKLMALRYA

SEQ ID NO: 1884 - protein, 81 aa, Artificial Sequence
  Computer-generated peptide variant
LLKIFKRYLRLMPHKVRACKRAELARRCKLTYRFTKLEGLGLSEPEKRYAARTWKKIWGAKRTARKMDLLRIKNGRAQRNY

SEQ ID NO: 1885 - protein, 43 aa, Artificial Sequence
  Computer-generated peptide variant
KFKYMKKFIKRIRNCLHAKYRKKLASMRMSAALLARHYCNLAG

SEQ ID NO: 1886 - protein, 21 aa, Artificial Sequence
  Computer-generated peptide variant
KLKMFNRMLKKLRRSLHFDAL

SEQ ID NO: 1887 - protein, 34 aa, Artificial Sequence
  Computer-generated peptide variant
RLRWYRKYLRMLKRMKVWWRLGAFLCKDAKLLAT

SEQ ID NO: 1888 - protein, 26 aa, Artificial Sequence
  Computer-generated peptide variant
RLRYFQKLMKLLKKNASILDAEPRTA

SEQ ID NO: 1889 - protein, 27 aa, Artificial Sequence
  Computer-generated peptide variant
KLKFLHKYMKRFTKEVAPRALKLCLLM

SEQ ID NO: 1890 - protein, 21 aa, Artificial Sequence
  Computer-generated peptide variant
LMRLLRKFLKRLKRGWWDAAR

SEQ ID NO: 1891 - protein, 23 aa, Artificial Sequence
  Computer-generated peptide variant
LIRLITRLLRKLKRHVVRRQAAY

SEQ ID NO: 1892 - protein, 75 aa, Artificial Sequence
  Computer-generated peptide variant
KLKYWKKWYKLYCSKRRVRLTWKRMLKLGRKHRPDLLAVHFAQSRLAKMLYLAREAAKWAPSCNSDHKRLVAKAG

SEQ ID NO: 1893 - protein, 83 aa, Artificial Sequence
  Computer-generated peptide variant
KLKFYQKLLKRIRREKCRVPQRRDAKEKTFKHCAARSRCYSLPLIMAAHRMRKRDLRASLTALFRCERHAGADLKLAPHFRER

SEQ ID NO: 1894 - protein, 33 aa, Artificial Sequence
  Computer-generated peptide variant
KFKLLRRLYKKLRNRTLLSADAKYSSRRVLCIW

SEQ ID NO: 1895 - protein, 52 aa, Artificial Sequence
  Computer-generated peptide variant
LMKFWRRLLKRWKTKYTNMRTNKLKANKVAADAYNYDRALHKRRRLKCPMHA

SEQ ID NO: 1896 - protein, 48 aa, Artificial Sequence
  Computer-generated peptide variant
ILKLLKKFYKKMNCKIHANKHRLVALLALKMYKVKRAWCYTQNARGRA

SEQ ID NO: 1897 - protein, 49 aa, Artificial Sequence
  Computer-generated peptide variant
RLKFLKKFWRRIRKKNNCNWKGLAALALLNNILKRACRVTAFELKLLIT

SEQ ID NO: 1898 - protein, 30 aa, Artificial Sequence
  Computer-generated peptide variant
FIRFFRKLWKKLRHHKLASAGKPRLLNLRR

SEQ ID NO: 1899 - protein, 28 aa, Artificial Sequence
  Computer-generated peptide variant
WFRYYKRIMRLMQSSLKAARANAFLRKA

SEQ ID NO: 1900 - protein, 69 aa, Artificial Sequence
  Computer-generated peptide variant
KLRWYSKWIRLLKRLIKAIERLRLRKRILGNLKRLLNLHDKANMYKFSQAKRDHNFPAAHRVKARWLRF

SEQ ID NO: 1901 - protein, 85 aa, Artificial Sequence
  Computer-generated peptide variant
YFRFIRRLIKRWKRGNDRRACARAFRQPQHPFKKLRYRRAENRRAARKSTEDAAFFLRLHAALGKWALKFHRGCRAKKGNATVWA

SEQ ID NO: 1902 - protein, 77 aa, Artificial Sequence
  Computer-generated peptide variant
RLRMWRRMYRLFCPAKAKRAALQRKIKLMWLCKLGYRVFCIACKTTKAAKSRKVALRGKECHWMIVKKEAMKRLLNL

SEQ ID NO: 1903 - protein, 37 aa, Artificial Sequence
  Computer-generated peptide variant
MFRFIKRLLRFIKTRARRDGALREAAKAHCATTERLS

SEQ ID NO: 1904 - protein, 80 aa, Artificial Sequence
  Computer-generated peptide variant
IMRLMCRYIKLWRKLAWCQKPLFLARYSQLCAPKLTKFLKRACPYKCFRAIKKLPRAKLLMYRARWKQITKWKRVNLRRH

SEQ ID NO: 1905 - protein, 62 aa, Artificial Sequence
  Computer-generated peptide variant
RYKYWSKILRKLRRAQSKLPLAELVAPLEAAVWRKMLAKYLRKGNVFLFKYLAHKRILRSCQ

SEQ ID NO: 1906 - protein, 39 aa, Artificial Sequence
  Computer-generated peptide variant
RFRLWPKFLKLLKHRAAVMKAAIRDPILKRMLLMFERKK

SEQ ID NO: 1907 - protein, 30 aa, Artificial Sequence
  Computer-generated peptide variant
KWRFMRKLIKRFRKFKYMFFAAADLLALNR

SEQ ID NO: 1908 - protein, 38 aa, Artificial Sequence
  Computer-generated peptide variant
RFKLMKKLLRKLRNAPKRLVCRRNLGMWMWWAFWLLWR

SEQ ID NO: 1909 - protein, 62 aa, Artificial Sequence
  Computer-generated peptide variant
RIRLMKKFLKLLKHICKGMSRWAYLLKMCAILCELKCPNDKFLADRKLWLCLHKRREKTRAK

SEQ ID NO: 1910 - protein, 85 aa, Artificial Sequence
  Computer-generated peptide variant
RIRMLKRLIKKFRQMRSEGLKMARALRRRRKLKKRAEGTQLAPNQQMKFAHANCDFDKFPRHSLKLKYNTATSANKVLRAKVLLL

SEQ ID NO: 1911 - protein, 28 aa, Artificial Sequence
  Computer-generated peptide variant
RFRLLKRLYKWFRSKILFKVSKWDAAAC

SEQ ID NO: 1912 - protein, 67 aa, Artificial Sequence
  Computer-generated peptide variant
LLRWFKRMIRKFRTLRVRNHKCLWAASKPFRTKRCKMKCRVRLARLKTLLGAPLACSEPYQKMAGKL

SEQ ID NO: 1913 - protein, 40 aa, Artificial Sequence
  Computer-generated peptide variant
ILRLLRKYLKKIRTNWALEGGRNLPAGFAKWLGALLRLMR

SEQ ID NO: 1914 - protein, 23 aa, Artificial Sequence
  Computer-generated peptide variant
LFRLFKRFLKRYQRAAGHKQAFR

SEQ ID NO: 1915 - protein, 31 aa, Artificial Sequence
  Computer-generated peptide variant
RLRLLQRFLRRLPRKSKLMIDYLRPLHLEAS

SEQ ID NO: 1916 - protein, 36 aa, Artificial Sequence
  Computer-generated peptide variant
KYRIIKKIMKRLCKRTLAAYAEKLPADNMRNLAGLR

SEQ ID NO: 1917 - protein, 43 aa, Artificial Sequence
  Computer-generated peptide variant
KLKIFRKFMRKLRKLAARAELVDKEKAICGAQTATKKHKQVLS

SEQ ID NO: 1918 - protein, 70 aa, Artificial Sequence
  Computer-generated peptide variant
WYKFFKRLWRYLKKKSLTWANKERPRKGAKQCIAAKYAWYLGLLQVHAPLWLRKCRRAKWKAAGKGAKNL

SEQ ID NO: 1919 - protein, 31 aa, Artificial Sequence
  Computer-generated peptide variant
MLKLIKKLFKKLPRNTSLKGAALAIKKGGGV

SEQ ID NO: 1920 - protein, 37 aa, Artificial Sequence
  Computer-generated peptide variant
RLRFMHRFLKLFSSKLRHKLDFQAAARVRKRYLHRLK

SEQ ID NO: 1921 - protein, 44 aa, Artificial Sequence
  Computer-generated peptide variant
RYKYFSKFFRRWRTRMAARPNKNSLLKLLLLLAWMAALQYHAVR

SEQ ID NO: 1922 - protein, 26 aa, Artificial Sequence
  Computer-generated peptide variant
RMKLMRRLLRKFRQALRLNQNNAVGN

SEQ ID NO: 1923 - protein, 100 aa, Artificial Sequence
  Computer-generated peptide variant
YLRYLKKFYKWLKKTLKSNLNDLKPLRFADRKLCPVEYLLKCFVKENARRTVRTKLLMKACLIRSRQRKDKLAWAANTNAVLKNRKTIRRRRLAIMAFRG

SEQ ID NO: 1924 - protein, 36 aa, Artificial Sequence
  Computer-generated peptide variant
KFRLFCKILKRMRKLPRGPKAKALYSAGQLWKLAWW

SEQ ID NO: 1925 - protein, 25 aa, Artificial Sequence
  Computer-generated peptide variant
RFKFWHKLWKKLKSAYGKELMAKLF

SEQ ID NO: 1926 - protein, 77 aa, Artificial Sequence
  Computer-generated peptide variant
RIKLYRKLMKRFCRNLLLNWRLLWAQVFAKWINIVLLRAPEILVAAAVKRLRMECSLALKLGILKKGRRTALIHGMR

SEQ ID NO: 1927 - protein, 42 aa, Artificial Sequence
  Computer-generated peptide variant
LFKFFQKLLKKIRSKLYIAALRMQLKRWNAALVFYRCVLHRK

SEQ ID NO: 1928 - protein, 21 aa, Artificial Sequence
  Computer-generated peptide variant
FFRLFPRLLRLYCSRVKTAKL

SEQ ID NO: 1929 - protein, 26 aa, Artificial Sequence
  Computer-generated peptide variant
KWRWWHKWLRKIKNAADAKLVNKAAL

SEQ ID NO: 1930 - protein, 58 aa, Artificial Sequence
  Computer-generated peptide variant
KFRFLHRLLRLLRKLLRTILMAMKQFAWKRLRNLRSLLCTAFDKELPYLNAEALLRKR

SEQ ID NO: 1931 - protein, 20 aa, Artificial Sequence
  Computer-generated peptide variant
WLRFMKRLMKIWCTLLEARA

SEQ ID NO: 1932 - protein, 35 aa, Artificial Sequence
  Computer-generated peptide variant
KWKWLRKFLKRLRQALAWAEEEFWVNGKLLGCLKR

SEQ ID NO: 1933 - protein, 27 aa, Artificial Sequence
  Computer-generated peptide variant
LFKFYCKFFKRISHAASLIKLDLRKKL

SEQ ID NO: 1934 - protein, 60 aa, Artificial Sequence
  Computer-generated peptide variant
YLRWMRKFWKKFKPRVRRELIHRLAEKMKKQNPGLILYKFAKLRACLLGSRLHLRLLSMT

SEQ ID NO: 1935 - protein, 27 aa, Artificial Sequence
  Computer-generated peptide variant
IFKLWNKFLRRYQTHLRKALTLRGAKR

SEQ ID NO: 1936 - protein, 33 aa, Artificial Sequence
  Computer-generated peptide variant
RLKLMKRLLKFLRRLNWLLSALQFYWELNHKHW

SEQ ID NO: 1937 - protein, 53 aa, Artificial Sequence
  Computer-generated peptide variant
RWRWMNRLLKLMTKELSLAWIKPLGARLKRAARAFDDWKKRHKVPANLDILKI

SEQ ID NO: 1938 - protein, 20 aa, Artificial Sequence
  Computer-generated peptide variant
FIRFLRKILRRLQKAVLIKT

SEQ ID NO: 1939 - protein, 70 aa, Artificial Sequence
  Computer-generated peptide variant
FLRWLPRLMRRLKCRAEPFARNLLHRCIGLRHKKRKNGGLALRQWWLLRSLMIEKIPAAAELAAAEALKK

SEQ ID NO: 1940 - protein, 38 aa, Artificial Sequence
  Computer-generated peptide variant
LMRYYRKLLRRLKRVDALFDAVLTPKLNMNQLKKDMLH

SEQ ID NO: 1941 - protein, 32 aa, Artificial Sequence
  Computer-generated peptide variant
KMKFLRKMYRKWKKLACRHRVRAAGLYLLPVY

SEQ ID NO: 1942 - protein, 39 aa, Artificial Sequence
  Computer-generated peptide variant
IFKLWRKYIKLYKNAKIATAIRAAAARLIRTRKHRIMHK

SEQ ID NO: 1943 - protein, 33 aa, Artificial Sequence
  Computer-generated peptide variant
WMRIFNRLLKYIRKLALAKLAAKKCAPFRSQTG

SEQ ID NO: 1944 - protein, 30 aa, Artificial Sequence
  Computer-generated peptide variant
RYKILQKLLKKLKKQLRAPANIPCRWLKWT

SEQ ID NO: 1945 - protein, 37 aa, Artificial Sequence
  Computer-generated peptide variant
FIRLFNKIIKKLKKALVGCKLCAKFCDKLRALRAHHW

SEQ ID NO: 1946 - protein, 40 aa, Artificial Sequence
  Computer-generated peptide variant
KWRLLKRFFRRFRHESATKLFARSYRNSALLRLHFRVEKE

SEQ ID NO: 1947 - protein, 49 aa, Artificial Sequence
  Computer-generated peptide variant
RLKWWSKLMRRLKNAELRMCNGCQHPFCRALRARNRARRAKRIWRDPAA

SEQ ID NO: 1948 - protein, 40 aa, Artificial Sequence
  Computer-generated peptide variant
RIKFLRRYYKFMRNKMLNRPKRLVAIAATAHGWTLKAWAR

SEQ ID NO: 1949 - protein, 33 aa, Artificial Sequence
  Computer-generated peptide variant
KLKWMRKMWKMFKKKRCANLLARRLLKLKLAPA

SEQ ID NO: 1950 - protein, 50 aa, Artificial Sequence
  Computer-generated peptide variant
RIKLMRKLYKKIKKIELWLRAADRKIKAANRRQAHAKMKAQRFLCFDMRL

SEQ ID NO: 1951 - protein, 42 aa, Artificial Sequence
  Computer-generated peptide variant
RLKLLKRLMKRYTKKLKSCKALCKQCLMSHGTKAGRLKVWMM

SEQ ID NO: 1952 - protein, 33 aa, Artificial Sequence
  Computer-generated peptide variant
RWKLIRKLLRKLTRKAQRYLQGAIKLVPGNFYA

SEQ ID NO: 1953 - protein, 20 aa, Artificial Sequence
  Computer-generated peptide variant
ILRFLQRILRLWKCKKNACK

SEQ ID NO: 1954 - protein, 48 aa, Artificial Sequence
  Computer-generated peptide variant
MYRLFRRMLKLFTKKRLRKINARACMLDSSPKGRAYLEARAVFARDYK

SEQ ID NO: 1955 - protein, 20 aa, Artificial Sequence
  Computer-generated peptide variant
FLKFFKKLMRMLSQLAALKS

SEQ ID NO: 1956 - protein, 35 aa, Artificial Sequence
  Computer-generated peptide variant
KLRLLQRWLRRLQKLHVRGAMQFACCIDKRLAFAP

SEQ ID NO: 1957 - protein, 98 aa, Artificial Sequence
  Computer-generated peptide variant
LFRFLRKLLRKIRSYWEEKPRCRRSARAADATWLGKRRLSKAVRLIKMPAELWHKKLIQMRRIDQVNLRGLKANHKLKRRKAGLIRAPAILFMKTKLF

SEQ ID NO: 1958 - protein, 38 aa, Artificial Sequence
  Computer-generated peptide variant
RFKLIKKLLKLIQKFGACFYLFAKAWAQADELLYCKQR

SEQ ID NO: 1959 - protein, 70 aa, Artificial Sequence
  Computer-generated peptide variant
KYKLFCKWYRFFRRLDCQRKLRRANARRAPKLPKARAFLVRSSFRLGRFKRPPHELSKLHNLLKEMDRAL

SEQ ID NO: 1960 - protein, 50 aa, Artificial Sequence
  Computer-generated peptide variant
KLRLLPKFLKILSKIDKARALQRAIARRKHKLWAKKCIKCMAMKNLPLRL

SEQ ID NO: 1961 - protein, 60 aa, Artificial Sequence
  Computer-generated peptide variant
LMKFMRRWLRKLSSPLYRKQARKERLVKMTKKYQIQKRFKAEKQCAYVAAVKYLLAAFKA

SEQ ID NO: 1962 - protein, 45 aa, Artificial Sequence
  Computer-generated peptide variant
FLKLIRRFIKKLKRTAENRASLQCRAGKALWVASNRQHAHARRSF

SEQ ID NO: 1963 - protein, 56 aa, Artificial Sequence
  Computer-generated peptide variant
KFRLLQKFFKKLRKLFYLARDTMLLLKNRARPHIAESDKDARTMLLKLSLKMFGSL

SEQ ID NO: 1964 - protein, 73 aa, Artificial Sequence
  Computer-generated peptide variant
MLRWYNRLFKIMPQKRGDSKLFLRAVLKPTRRNLEVTLLKRTRAEARDFCKAADLRKRAIRRNCLKLLGWLLR

SEQ ID NO: 1965 - protein, 72 aa, Artificial Sequence
  Computer-generated peptide variant
LYRLFHRLFKLLRQRSADPTNTAQAKKQKLSRLGRADEARRNRRAIRPWLKAGKMDRGARAPKKLYKIAGLL

SEQ ID NO: 1966 - protein, 58 aa, Artificial Sequence
  Computer-generated peptide variant
KLRLFNRLLKKFTKWCREAKRNRKALHVCVKIAAPKRNLARLGRRRWARAGAARVGIL

SEQ ID NO: 1967 - protein, 41 aa, Artificial Sequence
  Computer-generated peptide variant
KLKLYQRYYKKFTPSKGALIKKDWHWYLKLKNARLFARALA

SEQ ID NO: 1968 - protein, 23 aa, Artificial Sequence
  Computer-generated peptide variant
KLRYIRKMLKWLCRLYLSAGPKS

SEQ ID NO: 1969 - protein, 22 aa, Artificial Sequence
  Computer-generated peptide variant
RYRFLPRLLKLFNRAAVFSKRW

SEQ ID NO: 1970 - protein, 32 aa, Artificial Sequence
  Computer-generated peptide variant
KLRLMPKFWRRYRCQRARFEDALAPNRALKYV

SEQ ID NO: 1971 - protein, 27 aa, Artificial Sequence
  Computer-generated peptide variant
KWRWLRKLMKMYQRYAYLKSKGGLLAK

SEQ ID NO: 1972 - protein, 23 aa, Artificial Sequence
  Computer-generated peptide variant
LFRILRRFLKILKSLLGLKRCER

SEQ ID NO: 1973 - protein, 23 aa, Artificial Sequence
  Computer-generated peptide variant
MFRLLRKYIRLFRNLKMKAHGCA

SEQ ID NO: 1974 - protein, 27 aa, Artificial Sequence
  Computer-generated peptide variant
WLRFFSKFLRLWRKRWTSLLRAELRAK

SEQ ID NO: 1975 - protein, 26 aa, Artificial Sequence
  Computer-generated peptide variant
RFRLFQRFLRFLKHFKALLRASTSAL

SEQ ID NO: 1976 - protein, 31 aa, Artificial Sequence
  Computer-generated peptide variant
MMRLFQKLWRRYKRAMRDSLAKANALGKEKF

SEQ ID NO: 1977 - protein, 30 aa, Artificial Sequence
  Computer-generated peptide variant
LIKMIRRILRRMNRTKAAMKSQAAAWPKHA

SEQ ID NO: 1978 - protein, 45 aa, Artificial Sequence
  Computer-generated peptide variant
RYKILHRFIKYYCKMKKCDAVLKKLALWLKKRLWMGLKKCSHLLL

SEQ ID NO: 1979 - protein, 25 aa, Artificial Sequence
  Computer-generated peptide variant
YYKLLCRLFKFWKQEEVRRLKWRAA

SEQ ID NO: 1980 - protein, 23 aa, Artificial Sequence
  Computer-generated peptide variant
WLRLFSRFIRRWRRAGAARHSTA

SEQ ID NO: 1981 - protein, 64 aa, Artificial Sequence
  Computer-generated peptide variant
LWKLLKRFFRWIKPARRAAASLLKALARPRLRVQNLRTPMTYRRLLMAMPGAPRQAQLHAPGNV

SEQ ID NO: 1982 - protein, 44 aa, Artificial Sequence
  Computer-generated peptide variant
KWKLLKRWIKKLRKTDYLNAYNHENLDSMVLKYARRKPERLAAR

SEQ ID NO: 1983 - protein, 43 aa, Artificial Sequence
  Computer-generated peptide variant
KMRLLTKLLKRWQKKDQADLKWYQVMRRFLDVAHCLAAALRYP

SEQ ID NO: 1984 - protein, 58 aa, Artificial Sequence
  Computer-generated peptide variant
RLKLLKKLYKRFCRQHARFRFKIGQKLKHRELGRKVAAIWSRQDQVASTRRAFLLLKC

SEQ ID NO: 1985 - protein, 24 aa, Artificial Sequence
  Computer-generated peptide variant
LLRMLHKMLRLFRKWKKPRYAFAW

SEQ ID NO: 1986 - protein, 29 aa, Artificial Sequence
  Computer-generated peptide variant
IMRYIHKLFKWFRHLRQANSAALAKRARR

SEQ ID NO: 1987 - protein, 47 aa, Artificial Sequence
  Computer-generated peptide variant
KLRFWKRMFKRLTRWLTSKQPLEDARLKKLWKRLRELHKSAANHAAL

SEQ ID NO: 1988 - protein, 69 aa, Artificial Sequence
  Computer-generated peptide variant
RFRWLTKMLKRWCRTLYTLCNRRSAWKARMNRAKNGYRALSAVKQALMMGAQSLQARALARRWRRRLDV

SEQ ID NO: 1989 - protein, 67 aa, Artificial Sequence
  Computer-generated peptide variant
RLKLIHKLFRLLKRLDRNRTRKFRQRGASKALRWLAYQTLMALKRIKIMCRLACKALVRMKTTWIFA

SEQ ID NO: 1990 - protein, 92 aa, Artificial Sequence
  Computer-generated peptide variant
KFRWLTRWLRKWKNPLDRRLHMLRHARTCRAKKKKEGADIIWRNLAMKYTSQLFHKDAVRAKRLRFAALARRLRIADATRRIANIKKHKDAL

SEQ ID NO: 1991 - protein, 32 aa, Artificial Sequence
  Computer-generated peptide variant
KLRLMHRLMRKWSKVLKVLRWLHKALFHKTFI

SEQ ID NO: 1992 - protein, 33 aa, Artificial Sequence
  Computer-generated peptide variant
KLRMWCRLLRRMNRMQIDGANMAPAFAALLLKK

SEQ ID NO: 1993 - protein, 20 aa, Artificial Sequence
  Computer-generated peptide variant
LFKMLRKILRRLKCELYPDA

SEQ ID NO: 1994 - protein, 49 aa, Artificial Sequence
  Computer-generated peptide variant
MMKWIKKLLRRLRRLTLRIPPRADALDATWRSECFKKFLCIALHLAALD

SEQ ID NO: 1995 - protein, 20 aa, Artificial Sequence
  Computer-generated peptide variant
LYKLWRKFLRKLKNDASPFC

SEQ ID NO: 1996 - protein, 36 aa, Artificial Sequence
  Computer-generated peptide variant
LMRLFRKLYKILKNARAERLEHMGFYYLKRPALEKQ

SEQ ID NO: 1997 - protein, 23 aa, Artificial Sequence
  Computer-generated peptide variant
LMKYLTKFLKRLRRRAGDVMKLW

SEQ ID NO: 1998 - protein, 31 aa, Artificial Sequence
  Computer-generated peptide variant
RLKFLTRMLKKFKRALDERRRRLLWLPGLCR

SEQ ID NO: 1999 - protein, 27 aa, Artificial Sequence
  Computer-generated peptide variant
MIRLLKKWFKRLCSLYWDKRAAIAKPA

SEQ ID NO: 2000 - protein, 65 aa, Artificial Sequence
  Computer-generated peptide variant
FFRLMSKWLKLLKKYCHSKCCGAAAVDHLKLANSWQKEALREKYAKDKPYKPLRVARAAKDLRQK

SEQ ID NO: 2001 - protein, 77 aa, Artificial Sequence
  Computer-generated peptide variant
LFRILSKMLRFLKKKMNIQAACKRNKLARCMWPKGLRLRARRRRANAAQEKCMFEGRLLAILCCLTPDKSQLLAAMF

SEQ ID NO: 2002 - protein, 54 aa, Artificial Sequence
  Computer-generated peptide variant
LFRFFTKLFKLISKLRKCRTKYRMRIRALAARSPAKEAWKLLLKFAKPQHLDEI

SEQ ID NO: 2003 - protein, 39 aa, Artificial Sequence
  Computer-generated peptide variant
KLRIFRRLWRFYKRLLRKEMAVADARYRMQRAPNADLPF

SEQ ID NO: 2004 - protein, 39 aa, Artificial Sequence
  Computer-generated peptide variant
KIKLWPKLIRRICSHRICANKKLARMLIRKAAAYLKITA

SEQ ID NO: 2005 - protein, 25 aa, Artificial Sequence
  Computer-generated peptide variant
LFKLLTKFYRKLTKSYGLKAHATKW

SEQ ID NO: 2006 - protein, 93 aa, Artificial Sequence
  Computer-generated peptide variant
LWRIYKKLIRRYRCRQRRLRHASRHNPKSAAMDKLNLRENKRSKLRLALMLHRARRADAKAFICAALHGHCWWIKPAHRKCLRLAADEKLVAR

SEQ ID NO: 2007 - protein, 39 aa, Artificial Sequence
  Computer-generated peptide variant
RLRLLPRYWRKIKSKTLRAWAVYTIHRMLCERLKLLRLV

SEQ ID NO: 2008 - protein, 55 aa, Artificial Sequence
  Computer-generated peptide variant
YWKLWRRIFKFLPKGKACHCKKACKLAQRLALAMMCLKKWVARRKADLNLKLTLN

SEQ ID NO: 2009 - protein, 20 aa, Artificial Sequence
  Computer-generated peptide variant
KMKLIRRFLKMMKQQTAYLA

SEQ ID NO: 2010 - protein, 87 aa, Artificial Sequence
  Computer-generated peptide variant
RFRWLRKFYRYFSRSHSHKAAKRRRTRLLLRRTSLGAKYQSRLFKERCKLKKLKCCKRALMNWRAFKALHHQTSAKDRKTLLLHYAH

SEQ ID NO: 2011 - protein, 43 aa, Artificial Sequence
  Computer-generated peptide variant
IIKLFSRLIRILRRGRYAHLAMCNKSAHLAKSLKFKRMAKILC

SEQ ID NO: 2012 - protein, 20 aa, Artificial Sequence
  Computer-generated peptide variant
LLKLISKLFRRFHQDKKASG

SEQ ID NO: 2013 - protein, 37 aa, Artificial Sequence
  Computer-generated peptide variant
RLRLWRKMLRMFRRTARMRGLLGSAHPCRAVYLLRVR

SEQ ID NO: 2014 - protein, 57 aa, Artificial Sequence
  Computer-generated peptide variant
LYRFMPRLYKKLRKQRPAAMAKLLYEFLHCKTAPRRLARLKALLHFLGLILKLKIWC

SEQ ID NO: 2015 - protein, 57 aa, Artificial Sequence
  Computer-generated peptide variant
MMRLLKRLFRLFHRDWECAVHPQRRDQLKNFGTLLRCKLRRAALRLKALEHDRRVHK

SEQ ID NO: 2016 - protein, 70 aa, Artificial Sequence
  Computer-generated peptide variant
KLKLIQRLWRYFCKEDRKHRECLLRRGDRMKRKLHAAGKLKLIAMMLIIKASFLRKRANAKLVGWIRSFP

SEQ ID NO: 2017 - protein, 98 aa, Artificial Sequence
  Computer-generated peptide variant
MLKLFCRFMKKMKRMIAMARADAGKEKFIVVHPATRKELTIYKMNKDKLLLMVLHLKDAARRAKKLPQLTKGRSYAAAASAKRAYDLATVAADKKRCY

SEQ ID NO: 2018 - protein, 76 aa, Artificial Sequence
  Computer-generated peptide variant
KLKIMRRFMKKLKNTGAKYGAWKQAYYAAKAAAVRANKKNKYEHAKSADDKERRAWARLLCNARKQTGWDRLGGER

SEQ ID NO: 2019 - protein, 37 aa, Artificial Sequence
  Computer-generated peptide variant
WYRFLRRFLRLFKRRNWLARFNLDLRLPFNAKAKCRN

SEQ ID NO: 2020 - protein, 30 aa, Artificial Sequence
  Computer-generated peptide variant
RLKLFKKIMKRLSRAFYPLLQGLKWVLKLK

SEQ ID NO: 2021 - protein, 72 aa, Artificial Sequence
  Computer-generated peptide variant
FLRFMKRFFRRMQRRLARKYTHKTPLCRKMHGSDLAQKRRLLVAPRKAWKKRCLLLIAKVLKKIRCYVVAAE

SEQ ID NO: 2022 - protein, 70 aa, Artificial Sequence
  Computer-generated peptide variant
RLRFLHRFMRFLKHMTKACALWAKEGRKRFRRRQLLWRRLEICQASRTRLLDKLLALKQINAAIDSFNHK

SEQ ID NO: 2023 - protein, 27 aa, Artificial Sequence
  Computer-generated peptide variant
KLRWLRKWFRLWKTALEQNRLILAKCR

SEQ ID NO: 2024 - protein, 24 aa, Artificial Sequence
  Computer-generated peptide variant
KLRLWKRFLRKLPRSLMGKWRALA

SEQ ID NO: 2025 - protein, 78 aa, Artificial Sequence
  Computer-generated peptide variant
WWRFLKRIFRRFSRSLLRKPIQYHHALLLLSLALALRKPKKKNKDAAQRRYKKKMILDDPQKFAALILFERNDLVNNL

SEQ ID NO: 2026 - protein, 38 aa, Artificial Sequence
  Computer-generated peptide variant
KLRMLSKLFRKLRKKAKRCNRGWMFPDKLPLALAMGAL

SEQ ID NO: 2027 - protein, 61 aa, Artificial Sequence
  Computer-generated peptide variant
RWRLFKRYMRKFRTQLLVGRVKRRLRYARLAAGAALARQLETVATNARILTYWRWVYASAT

SEQ ID NO: 2028 - protein, 79 aa, Artificial Sequence
  Computer-generated peptide variant
KYKMMNKLLKRIKRWAKDLQRIKKAMLAARMLLRHIAKQLEPIRVKNSLYCVLMDGRLAMRQLMPWRARARRHYRAPAP

SEQ ID NO: 2029 - protein, 25 aa, Artificial Sequence
  Computer-generated peptide variant
FFKLLKRLLRRMKRTCKNWLLCTCV

SEQ ID NO: 2030 - protein, 27 aa, Artificial Sequence
  Computer-generated peptide variant
RFRLFQRWLKIIKKRQALREAAQKVLA

SEQ ID NO: 2031 - protein, 38 aa, Artificial Sequence
  Computer-generated peptide variant
RFRWLQKMLRRFKHLKAILACLRAIAIAMGKQMDRKKC

SEQ ID NO: 2032 - protein, 53 aa, Artificial Sequence
  Computer-generated peptide variant
RMKWIKKWLKLMRNLTEKLFPALCFAMWALKAKALRKYRRPNGECEWRRALAA

SEQ ID NO: 2033 - protein, 74 aa, Artificial Sequence
  Computer-generated peptide variant
RYRILKKFLRRLPSLHKRRVYNLFDHAEDNPSAAALCLRIALNLALAALLKMAQQRFRLSREKHASRRFRLKMD

SEQ ID NO: 2034 - protein, 38 aa, Artificial Sequence
  Computer-generated peptide variant
LMKWIKRFFRWLQTLRLFLKRGHLRRKRWLACKLTHAL

SEQ ID NO: 2035 - protein, 34 aa, Artificial Sequence
  Computer-generated peptide variant
KIKLMRKFLRRLCRKLTRDTELRACLWGQDAWCR

SEQ ID NO: 2036 - protein, 29 aa, Artificial Sequence
  Computer-generated peptide variant
LIRYLNRLWRLLNKLSPRYLDARRLSKSD

SEQ ID NO: 2037 - protein, 20 aa, Artificial Sequence
  Computer-generated peptide variant
LIRMMHKFLRLLRRKFAFDK

SEQ ID NO: 2038 - protein, 33 aa, Artificial Sequence
  Computer-generated peptide variant
RLRWFPKWFRIWNHRLLMKAAKRHHLRGKQLRA

SEQ ID NO: 2039 - protein, 32 aa, Artificial Sequence
  Computer-generated peptide variant
KLRFFRRFYKLLCRRSKNAALHWLAQLGGTAE

SEQ ID NO: 2040 - protein, 93 aa, Artificial Sequence
  Computer-generated peptide variant
KWKLMTKLIKLYTNLEALASLAKLKRMASYTNPKTHTWRAFNKCKRWSMLAKEARPARAHNDKANKNKACVLARNPRAKYKARAPRLTLCAPR

SEQ ID NO: 2041 - protein, 42 aa, Artificial Sequence
  Computer-generated peptide variant
KLRWLPKFFRLFKHRKSPSLLKFKALLLAECAKHLRETGKWP

SEQ ID NO: 2042 - protein, 20 aa, Artificial Sequence
  Computer-generated peptide variant
RLKLLNRWIRWMCRRAAQVN

SEQ ID NO: 2043 - protein, 20 aa, Artificial Sequence
  Computer-generated peptide variant
FMKLFRRYLKKLSQPLASCA

SEQ ID NO: 2044 - protein, 74 aa, Artificial Sequence
  Computer-generated peptide variant
KIKFLHKFLRKMKTRLVWPNLPMCKYAAARPAYKKRAKAMWQARNRRLRWYDADRSFRRSAKHLKANRAWRLMY

SEQ ID NO: 2045 - protein, 60 aa, Artificial Sequence
  Computer-generated peptide variant
KLKMFHKWIRKLQPNRMRSKLRMLALCLYKAKLKLSLPSYKRLHVKFMTKALFAFPRRKP

SEQ ID NO: 2046 - protein, 70 aa, Artificial Sequence
  Computer-generated peptide variant
KLKFMRKMYKMLKSRAMLVKEWGNPAALPRGAGLMTARKAWDNKKKAEFAINLGARLNMRKTKDAIAALA

SEQ ID NO: 2047 - protein, 33 aa, Artificial Sequence
  Computer-generated peptide variant
RLKIMPKFFKKWKKALLARLSWAKEAASWRKTH

SEQ ID NO: 2048 - protein, 40 aa, Artificial Sequence
  Computer-generated peptide variant
RFRLFHKFLKRIRCHAKKAMTLRAEGRKSLADHLQRLQGT

SEQ ID NO: 2049 - protein, 48 aa, Artificial Sequence
  Computer-generated peptide variant
KWKFFKRIYRLLKHAAKKAMFHDDLALDALRTAKSRPKDVKARKYLFP

SEQ ID NO: 2050 - protein, 80 aa, Artificial Sequence
  Computer-generated peptide variant
LMRLWRKILRWMTTMRTCKWEVKNYWPLRLKHALLTALKRRCIQSKDILRLAVLGNRAALLKKRKDMLLPAMAPLAIIRA

SEQ ID NO: 2051 - protein, 40 aa, Artificial Sequence
  Computer-generated peptide variant
RLKWYNRFLRRLTKEATANAKKVFDMALARLDHTRCKNAR

SEQ ID NO: 2052 - protein, 43 aa, Artificial Sequence
  Computer-generated peptide variant
LLRLICKWFKLLRKLRCCRLLLKNFVHALIASLHCWRSARCKA

SEQ ID NO: 2053 - protein, 21 aa, Artificial Sequence
  Computer-generated peptide variant
WLRFLKKILKKYTRIARLAIA

SEQ ID NO: 2054 - protein, 99 aa, Artificial Sequence
  Computer-generated peptide variant
KLRFIRRIMRKIRKNKVLLLAARLKARAGKEQEQRKKALRIIRGSWKLMLKAWLMKNALVQALMKLAYHFRKGCRKYQYRAKANGPRLKPQKKELAVPK

SEQ ID NO: 2055 - protein, 51 aa, Artificial Sequence
  Computer-generated peptide variant
KLKILKRYMKRIPKAKSKLENLALKYLKYVLLKREGILRRIECISKRATIA

SEQ ID NO: 2056 - protein, 23 aa, Artificial Sequence
  Computer-generated peptide variant
LLKLLHRIWKLFRRCNMRAAAIS

SEQ ID NO: 2057 - protein, 72 aa, Artificial Sequence
  Computer-generated peptide variant
KLRWWKKFFRRLRQRTASWFGMKSFLCVGKFALNLKALARRKAKYQFLLYKAADSKIGALKAGRKLRDDSGA

SEQ ID NO: 2058 - protein, 59 aa, Artificial Sequence
  Computer-generated peptide variant
ILKWLKKLLKRLKKKKHPQHALEKVENGAAIRWTCKHLPLMIAAKLKYMKFKALPARLM

SEQ ID NO: 2059 - protein, 21 aa, Artificial Sequence
  Computer-generated peptide variant
MMRWYRRFLKRWRKAALLADR

SEQ ID NO: 2060 - protein, 52 aa, Artificial Sequence
  Computer-generated peptide variant
KYKFIQKFLKLFKKASLKALPGAAWGELSILKLALMKIKTCRDLSIEWKKKR

SEQ ID NO: 2061 - protein, 29 aa, Artificial Sequence
  Computer-generated peptide variant
LLKLLTKYFKFYRKLAYYSSFHKFKLPKK

SEQ ID NO: 2062 - protein, 70 aa, Artificial Sequence
  Computer-generated peptide variant
RMRLLKKYLKKLRRRLIGRRWMNNACLRSLKADPCSAELALMCCLRLDELFLARDKDRLKSKAMRNIPNF

SEQ ID NO: 2063 - protein, 53 aa, Artificial Sequence
  Computer-generated peptide variant
KWKFWNKLFKYFRRIGWRRAKAWLKKAKAEPQTPMLKRRRCGPLLLLHLAGYK

SEQ ID NO: 2064 - protein, 48 aa, Artificial Sequence
  Computer-generated peptide variant
FFKYYKKLLKFLTRLLKKKKCRRPTWLARAACWAKSRGMMNYAPRKQA

SEQ ID NO: 2065 - protein, 67 aa, Artificial Sequence
  Computer-generated peptide variant
LIRFYNRWMRKWRKSKLTVELLCGAPRSFLTWLEWAQNLRIKRSLARPIYLLNKLRKARATLRLNAA

SEQ ID NO: 2066 - protein, 72 aa, Artificial Sequence
  Computer-generated peptide variant
YWKLLRKFYRWMRNKYFQTKIRKKESGALAALRLKPRLCKFFERKKRAHLAACMLYLYRKLALGNLLELRLR

SEQ ID NO: 2067 - protein, 24 aa, Artificial Sequence
  Computer-generated peptide variant
LLRILKKLLKRFHRKAQRVNAFRD

SEQ ID NO: 2068 - protein, 36 aa, Artificial Sequence
  Computer-generated peptide variant
FFRMITKLMKRWKHKLMAKAAFKKKTALWKLRGSNL

SEQ ID NO: 2069 - protein, 30 aa, Artificial Sequence
  Computer-generated peptide variant
MLKFFRRWLRKLKQLKPMLWVKAGACDKLL

SEQ ID NO: 2070 - protein, 70 aa, Artificial Sequence
  Computer-generated peptide variant
RFRLWRRFWRKMSRFDKNARWRKASPFALAWWASKIRCREARTVSLQAKVQNKLEAPRLAALLRAMALEL

SEQ ID NO: 2071 - protein, 81 aa, Artificial Sequence
  Computer-generated peptide variant
LLKLMRKLFRFMTHKLQTCFRRLVKLLAGPRYRAKLEKLRLTVRMKRAGTAKALNRPLKKQRYGIAVSFLPRRFFTMVARV

SEQ ID NO: 2072 - protein, 82 aa, Artificial Sequence
  Computer-generated peptide variant
LFKIYRRFWKKLHKWTLHRGLLALAYQLRGAWNRFMTARRMAASRKKQRHKSPRKLRYKALRADFNILATKKLQTAYWCLRS

SEQ ID NO: 2073 - protein, 27 aa, Artificial Sequence
  Computer-generated peptide variant
RLRYWKKILRRLKSLASNKATNYIRLP

SEQ ID NO: 2074 - protein, 25 aa, Artificial Sequence
  Computer-generated peptide variant
KLRLMKRWMRKLSRDRPAAKLLYYL

SEQ ID NO: 2075 - protein, 50 aa, Artificial Sequence
  Computer-generated peptide variant
RFKILKKYLRIFSRAKVTLLRRCRIRWPLALNQLVRAQRFAAMKALRLVK

SEQ ID NO: 2076 - protein, 27 aa, Artificial Sequence
  Computer-generated peptide variant
FWKIFPRLFRLISTHALAWDRKLKAKL

SEQ ID NO: 2077 - protein, 21 aa, Artificial Sequence
  Computer-generated peptide variant
RWRLMPKLLRMLTKWAKQRQD

SEQ ID NO: 2078 - protein, 20 aa, Artificial Sequence
  Computer-generated peptide variant
KYKLYKKLLRLLRCMGQGLF

SEQ ID NO: 2079 - protein, 23 aa, Artificial Sequence
  Computer-generated peptide variant
WFKLLNKMFKRMTRELYKLEARA

SEQ ID NO: 2080 - protein, 25 aa, Artificial Sequence
  Computer-generated peptide variant
KLRWFKRLWKKMHKMKLTHKAALVL

SEQ ID NO: 2081 - protein, 25 aa, Artificial Sequence
  Computer-generated peptide variant
FYRFFRKFLRLLKHLKWDAVNRAFA

SEQ ID NO: 2082 - protein, 36 aa, Artificial Sequence
  Computer-generated peptide variant
RLRWLSRLIKMFQRCKDCLAGLVKRLGKLKDYNGAA

SEQ ID NO: 2083 - protein, 20 aa, Artificial Sequence
  Computer-generated peptide variant
YMRYLRKLLKKLQKLWQKVE

SEQ ID NO: 2084 - protein, 69 aa, Artificial Sequence
  Computer-generated peptide variant
LLKIFKRFIRRFSRRRAIVLKIHMRVHLKALPKLLKVRLEARDAYDPEKLHYRWLLNLCALLSAQDLWK

SEQ ID NO: 2085 - protein, 37 aa, Artificial Sequence
  Computer-generated peptide variant
KLKLFRRMLKKMKKIMELGRYWKAPAVLCLDKALWGI

SEQ ID NO: 2086 - protein, 24 aa, Artificial Sequence
  Computer-generated peptide variant
RYRWLRRLYRRLKNFYKWAQARAL

SEQ ID NO: 2087 - protein, 20 aa, Artificial Sequence
  Computer-generated peptide variant
LLRLMKRFFKFFRRAREACA

SEQ ID NO: 2088 - protein, 30 aa, Artificial Sequence
  Computer-generated peptide variant
ILKFIKKLLKRMKKDLLDKDAVQLYKIHLL

SEQ ID NO: 2089 - protein, 61 aa, Artificial Sequence
  Computer-generated peptide variant
MFKLFKKIFKKFRHALGGITLRRAKGRNLTWKRQRRRAPPYRLAILRAKHRIAAVKAVAIT

SEQ ID NO: 2090 - protein, 23 aa, Artificial Sequence
  Computer-generated peptide variant
KLRILRRLMRKFRHKLLALLPLR

SEQ ID NO: 2091 - protein, 36 aa, Artificial Sequence
  Computer-generated peptide variant
RIRWLNKFLRRWQSGRKLKGRLMPNYALALLFLRAE

SEQ ID NO: 2092 - protein, 34 aa, Artificial Sequence
  Computer-generated peptide variant
MWRLWRRILKKIKRHKWLLWTLAIARAYILLAEL

SEQ ID NO: 2093 - protein, 38 aa, Artificial Sequence
  Computer-generated peptide variant
MLRFLKKLIRRWQKMLYLSARFTALAYRHAVKWAVTIK

SEQ ID NO: 2094 - protein, 27 aa, Artificial Sequence
  Computer-generated peptide variant
KLKLWKRFFKKFRRAANNPAAQLKSSF

SEQ ID NO: 2095 - protein, 50 aa, Artificial Sequence
  Computer-generated peptide variant
KLRLIKRLFKRWKKAAHRDKWMYNAAQLQVCRALNRDSAFHRLLSLRLKM

SEQ ID NO: 2096 - protein, 38 aa, Artificial Sequence
  Computer-generated peptide variant
KLKMIHKLMRWLKKLLRELKLMQLLEAQKQLLMQEAKR

SEQ ID NO: 2097 - protein, 83 aa, Artificial Sequence
  Computer-generated peptide variant
KFKYFRKLFRWYCKHAKKARHKSAAMRRLKEVLQRDQKLMRLLNLLRKLGRKEDPPAAPACAYRSRAQADSAYFAKTTKTERG

SEQ ID NO: 2098 - protein, 48 aa, Artificial Sequence
  Computer-generated peptide variant
RYKFWQRFMRRFKKVKAIRFKRLANKAKACALDNLLWRKAAHNQQMLL

SEQ ID NO: 2099 - protein, 33 aa, Artificial Sequence
  Computer-generated peptide variant
KLRFWRRFMKKLQKNRTRDRNHCAPIMAKLLLL

SEQ ID NO: 2100 - protein, 20 aa, Artificial Sequence
  Computer-generated peptide variant
RMRLYCKFLKKMHRILLLIK

SEQ ID NO: 2101 - protein, 34 aa, Artificial Sequence
  Computer-generated peptide variant
KFKLLNRLLKRLKSVFMKHIRMKKALRAARHLAA

SEQ ID NO: 2102 - protein, 33 aa, Artificial Sequence
  Computer-generated peptide variant
RYKFWRKFFKFLRKMDGLGLRAFEKGRLLKPLL

SEQ ID NO: 2103 - protein, 23 aa, Artificial Sequence
  Computer-generated peptide variant
LWKLLNRIYKLMKKRKSKDLAAK

SEQ ID NO: 2104 - protein, 85 aa, Artificial Sequence
  Computer-generated peptide variant
LWKLWKRWYRFFSRKPLREGFLILDLDARLAALPKCEKARRYAARKWKKMSARARCKAAQQCTRNREGLKQLLIAKDAALKCGKL

SEQ ID NO: 2105 - protein, 22 aa, Artificial Sequence
  Computer-generated peptide variant
KLKLLNRLFRFLRKATPKKFLN

SEQ ID NO: 2106 - protein, 25 aa, Artificial Sequence
  Computer-generated peptide variant
RLRFYSKYLKKLHRKCASKYPLPLQ

SEQ ID NO: 2107 - protein, 26 aa, Artificial Sequence
  Computer-generated peptide variant
YIKLFKKFLKFLRCAVHKLKAASKGL

SEQ ID NO: 2108 - protein, 34 aa, Artificial Sequence
  Computer-generated peptide variant
KWKLLSRWFRKYCKLWAIALRPMRKGILPAKAYR

SEQ ID NO: 2109 - protein, 36 aa, Artificial Sequence
  Computer-generated peptide variant
FLKLLKKFYRILKRCQRRKAMPYKDLTCASKLLNMA

SEQ ID NO: 2110 - protein, 53 aa, Artificial Sequence
  Computer-generated peptide variant
LLKFMKRMYRRLNRAYLAFAICPRKSCKQQYNRKRARMRKLRCLLRGGALNCR

SEQ ID NO: 2111 - protein, 27 aa, Artificial Sequence
  Computer-generated peptide variant
RLKMYRRILKKLRKHRADMRPALRLAA

SEQ ID NO: 2112 - protein, 73 aa, Artificial Sequence
  Computer-generated peptide variant
FMKYFRRWFKFFRCANFSGLALAQKYRLFTLRAILHYRLQARRKRACTWRRKERLCFQREKVAAPGKLAALLL

SEQ ID NO: 2113 - protein, 51 aa, Artificial Sequence
  Computer-generated peptide variant
RLRWLSRIFRRFQRLARAMWEKRYKALPDLYDRMEKKKLPEAPAALNRAGK

SEQ ID NO: 2114 - protein, 20 aa, Artificial Sequence
  Computer-generated peptide variant
LFKLMKKMFKLLNKLHAHYV

SEQ ID NO: 2115 - protein, 48 aa, Artificial Sequence
  Computer-generated peptide variant
RFRMLPRLMKKWRHDKAQLFHALRALKQWGARAAHLKCRGKRARYMTC

SEQ ID NO: 2116 - protein, 20 aa, Artificial Sequence
  Computer-generated peptide variant
ILRMIRRFIRRLKKLLHPYA

SEQ ID NO: 2117 - protein, 39 aa, Artificial Sequence
  Computer-generated peptide variant
FFKFLTKLLRWMRRAAAQALVRAIPSYAKGSYRRKPAHL

SEQ ID NO: 2118 - protein, 37 aa, Artificial Sequence
  Computer-generated peptide variant
KLKFWKRWMRRLHKHAKDHLHRMYMTARALNALSARE

SEQ ID NO: 2119 - protein, 24 aa, Artificial Sequence
  Computer-generated peptide variant
KWKWLQRLWKLFNKVLPKQLKQKL

SEQ ID NO: 2120 - protein, 42 aa, Artificial Sequence
  Computer-generated peptide variant
IYKYLRRMFKKLRHAVWKKKLHRGNHALRMYLNAMLLAHKRL

SEQ ID NO: 2121 - protein, 40 aa, Artificial Sequence
  Computer-generated peptide variant
YWRWFKRLWRKFKHPPRLILAKRFVLAQRDGDLWKDRKLL

SEQ ID NO: 2122 - protein, 33 aa, Artificial Sequence
  Computer-generated peptide variant
KFKYINKLWKLWRKKAPICLPLATIRKKLKAQC

SEQ ID NO: 2123 - protein, 30 aa, Artificial Sequence
  Computer-generated peptide variant
RFKFLPKLFRYWNKLLELRSLRHALPALAR

SEQ ID NO: 2124 - protein, 43 aa, Artificial Sequence
  Computer-generated peptide variant
RLKYIKKLLKKLRNALQKLKLDREKSYWNGRSVAYLYAIACME

SEQ ID NO: 2125 - protein, 60 aa, Artificial Sequence
  Computer-generated peptide variant
RMKWLKRLFKRWKTPTPAAALIEKSLLRNVLRPLAQALKHKWAKCMHWRFLSTKYPAHRL

SEQ ID NO: 2126 - protein, 47 aa, Artificial Sequence
  Computer-generated peptide variant
LFRYLKKFLRKFPRRTLLLCQRRSAAYAFLFLFAQRVAMRRRARMKK

SEQ ID NO: 2127 - protein, 31 aa, Artificial Sequence
  Computer-generated peptide variant
YLKIIRRLLRLLRRNLKSFRCFAPVQLARCL

SEQ ID NO: 2128 - protein, 29 aa, Artificial Sequence
  Computer-generated peptide variant
MYKILCRILRLYHKRRQLIRCEAIALLNL

SEQ ID NO: 2129 - protein, 80 aa, Artificial Sequence
  Computer-generated peptide variant
IWKIFKKFLRRMRKHYKALTYMRRMLATMWHKARKRRRFAGAVRDAGPLLHCACRRAYFVKKRKQKYLILGLCARNLVRH

SEQ ID NO: 2130 - protein, 42 aa, Artificial Sequence
  Computer-generated peptide variant
KLKLFHRMLRRMCRGLYAEMRLRRLKKGHFFSWLKALALSHD

SEQ ID NO: 2131 - protein, 47 aa, Artificial Sequence
  Computer-generated peptide variant
RLKLFKRYYRKLQQKMSKLALQSTWELARWLLLPREFTAYTKDELAR

SEQ ID NO: 2132 - protein, 24 aa, Artificial Sequence
  Computer-generated peptide variant
RLKLLHKMYKKMTRPRFRLMLLPW

SEQ ID NO: 2133 - protein, 56 aa, Artificial Sequence
  Computer-generated peptide variant
KYRYFKRLLKKFHQTLCARRKALWRLNRLCHLLASQKCAPCHEIAIKKILPVATAR

SEQ ID NO: 2134 - protein, 23 aa, Artificial Sequence
  Computer-generated peptide variant
KLRYLCKWFKRIKTLALAYARVT

SEQ ID NO: 2135 - protein, 52 aa, Artificial Sequence
  Computer-generated peptide variant
RYKFIKRWYKKITSLDLRWLLNAEVSWRSKEQALRALLLAGELGKYAARAKW

SEQ ID NO: 2136 - protein, 54 aa, Artificial Sequence
  Computer-generated peptide variant
WLKLMRKLIRRMCRTPAELKLVAKSEYCDRARAGKDKTSMRLKKWTAWKARDRL

SEQ ID NO: 2137 - protein, 62 aa, Artificial Sequence
  Computer-generated peptide variant
KFRMMHKLFRIFRSIWRVLRPARAAALDAELHAKTRCARLKTNRLIAKKEATKRKCSLIEAS

SEQ ID NO: 2138 - protein, 40 aa, Artificial Sequence
  Computer-generated peptide variant
KLRLFKKFLKRMSKWYLAADGAALACRIEEDMRFVGSLRL

SEQ ID NO: 2139 - protein, 35 aa, Artificial Sequence
  Computer-generated peptide variant
KMKLLRRMLKRLNRACNDYRLNCWLPADRGRAACA

SEQ ID NO: 2140 - protein, 31 aa, Artificial Sequence
  Computer-generated peptide variant
LIRFFRKYIKRLNKADLRQLKQAAYRCRANL

SEQ ID NO: 2141 - protein, 25 aa, Artificial Sequence
  Computer-generated peptide variant
KMKWWRRYFRLLKRWITLKDAELSA

SEQ ID NO: 2142 - protein, 41 aa, Artificial Sequence
  Computer-generated peptide variant
RLKLFKKLWRLWTRLRAIQHVALKSFALRWLQDYLKFAQIE

SEQ ID NO: 2143 - protein, 84 aa, Artificial Sequence
  Computer-generated peptide variant
MYKFLHKLWKKFTRRLVQLPPYLAYIRLRPRRLRLHLKANKQWRFYDYRPLNAGIIRLNLAKKAASACKLLRRRRPMLNTARFY

SEQ ID NO: 2144 - protein, 66 aa, Artificial Sequence
  Computer-generated peptide variant
KLKFLCKYFRWLRKWVIYTIPLELNPIVASKARRFAAWKKAKLQRKERNRLAKKNLLTAKSTEKKG

SEQ ID NO: 2145 - protein, 64 aa, Artificial Sequence
  Computer-generated peptide variant
RFKFLCKLLRRWCRLLRRLKALNWCLLGVKHPLFRALEYSAGMAAHTMDVPRLAARKFRWLRWQ

SEQ ID NO: 2146 - protein, 46 aa, Artificial Sequence
  Computer-generated peptide variant
YLKYFKKFFKLLRCKSLIFPAARLLFAMKERRCHALQRCRLKAASK

SEQ ID NO: 2147 - protein, 20 aa, Artificial Sequence
  Computer-generated peptide variant
RLKWFHRFWKKLKCALDHAL

SEQ ID NO: 2148 - protein, 55 aa, Artificial Sequence
  Computer-generated peptide variant
RMRLYRRFYKKMKRIRKRKLKELLILHVLFMRAAKAYLALTRTHLRAKAAHRDDI

SEQ ID NO: 2149 - protein, 45 aa, Artificial Sequence
  Computer-generated peptide variant
FFKMYRKLLKLFKRARARLTGALAYERAVCFRAPDHALSQLIQKC

SEQ ID NO: 2150 - protein, 73 aa, Artificial Sequence
  Computer-generated peptide variant
RLKLIRKLLRKWRRMLPCAHRHRKLLRAAKTAALFSIKWIKAFDTGLRRCRLMKLAGWRKAKCKIRQLKMATF

SEQ ID NO: 2151 - protein, 80 aa, Artificial Sequence
  Computer-generated peptide variant
ILRLWRRWWKRLKKCWLAKQAHKRCKERLWLCLELIASFCCTKVRKRRTEKFLIRRFLQLLLLAGSDCNTLKYKRWARND

SEQ ID NO: 2152 - protein, 24 aa, Artificial Sequence
  Computer-generated peptide variant
RMRLLRRFWKKYNQLKLKLLQFMD

SEQ ID NO: 2153 - protein, 26 aa, Artificial Sequence
  Computer-generated peptide variant
LWRYLRRWFRLLKRHDMRLLLGRAPH

SEQ ID NO: 2154 - protein, 36 aa, Artificial Sequence
  Computer-generated peptide variant
WWKLLQKLFKRIRCEWHLSPRLKELLHKLLLKRRCA

SEQ ID NO: 2155 - protein, 59 aa, Artificial Sequence
  Computer-generated peptide variant
RLKLFKKIIKKMNKRLDSEAKWAVDTWAKLELWKFKKRKCCICLKAAAGRIRASMLGKV

SEQ ID NO: 2156 - protein, 61 aa, Artificial Sequence
  Computer-generated peptide variant
RFRLWNKIIRYMKRLFKKLQRSAALRALKLSYKRLCQLCWAAAAVTARGWKELEALDALAK

SEQ ID NO: 2157 - protein, 36 aa, Artificial Sequence
  Computer-generated peptide variant
KLKWWKRLMRYFRQPLARHMADQWATRKRNEAWLAL

SEQ ID NO: 2158 - protein, 51 aa, Artificial Sequence
  Computer-generated peptide variant
RLRMLKKWMRKLKCLAHVKAIALGLKARRWALKMFLGEPCIKLIWFKWRKK

SEQ ID NO: 2159 - protein, 68 aa, Artificial Sequence
  Computer-generated peptide variant
KWRLIKRIFRFIRRKLCTRALMGRLALIGRRCARRRAHAVAMAWAIAKTDYTRQYCKIRYLGKKNSLA

SEQ ID NO: 2160 - protein, 43 aa, Artificial Sequence
  Computer-generated peptide variant
RLKMLRKFLKLFKRHKTDISLFYCPCLHAFRLKIKARTRKGLV

SEQ ID NO: 2161 - protein, 23 aa, Artificial Sequence
  Computer-generated peptide variant
RFRFLCKLYRKLTKTYTYARALA

SEQ ID NO: 2162 - protein, 41 aa, Artificial Sequence
  Computer-generated peptide variant
KFKFFKKYMKLINTLHARHCLKADATFKARGACKRLGGLLR

SEQ ID NO: 2163 - protein, 25 aa, Artificial Sequence
  Computer-generated peptide variant
YLKFFRKFWRILKRDTCRQASLRLA

SEQ ID NO: 2164 - protein, 51 aa, Artificial Sequence
  Computer-generated peptide variant
RIKYFRRYWKLIRCKRALALRIPDAKKAKTCAALSSAQRLKAHKCRARYCF

SEQ ID NO: 2165 - protein, 44 aa, Artificial Sequence
  Computer-generated peptide variant
IYRWLRRLMKLYRHYRKRRIAQPKRLAHAQLRKHANLHAQLLQM

SEQ ID NO: 2166 - protein, 36 aa, Artificial Sequence
  Computer-generated peptide variant
IYRLLRRLIKFMHPKKSDMELFRRTKAMLLALTARK

SEQ ID NO: 2167 - protein, 43 aa, Artificial Sequence
  Computer-generated peptide variant
RFRWLKKYLKYLKHRALLAKKNNNLNELSLYKRAKGFVLKDPY

SEQ ID NO: 2168 - protein, 50 aa, Artificial Sequence
  Computer-generated peptide variant
KFRYFCRFFRRLTTLHKKLDAEALRKKRFRECELLLKALRYKKAAQPAKA

SEQ ID NO: 2169 - protein, 38 aa, Artificial Sequence
  Computer-generated peptide variant
ILKLLKRYFKLLRRKANARRPKCFKVYLFLHLRWPKNT

SEQ ID NO: 2170 - protein, 33 aa, Artificial Sequence
  Computer-generated peptide variant
YFKLIKKLYRFYSRASLRRLRAFPFRALTDAQK

SEQ ID NO: 2171 - protein, 36 aa, Artificial Sequence
  Computer-generated peptide variant
YYKIYKRLIRLLKSWQKRLFATAENKKNRREAADLA

SEQ ID NO: 2172 - protein, 30 aa, Artificial Sequence
  Computer-generated peptide variant
LWKMFRRFLKKLHRMAICLRRVPWAADARR

SEQ ID NO: 2173 - protein, 44 aa, Artificial Sequence
  Computer-generated peptide variant
LLKIWRKFLRKLQKCWRALARATYFLTAYKQKRQPAQMLMCAGA

SEQ ID NO: 2174 - protein, 20 aa, Artificial Sequence
  Computer-generated peptide variant
LFKMLSKLWRRLRQSHWKWL

SEQ ID NO: 2175 - protein, 42 aa, Artificial Sequence
  Computer-generated peptide variant
RLKFMKKMYRKMRRGAIAALRPKPNLYKRANTALDLAAIGHM

SEQ ID NO: 2176 - protein, 62 aa, Artificial Sequence
  Computer-generated peptide variant
FLRLLRRLLRKLRCYQLCKYRCAVKMRLKKMRKWMRRNFLQKAHMGCLMTLAQAHKKARLLV

SEQ ID NO: 2177 - protein, 59 aa, Artificial Sequence
  Computer-generated peptide variant
LLRLLRRLWKFLKNSTRNRLKCTPQNADRLWLLYVALPARDEGLAGKNRDFLFLRYANK

SEQ ID NO: 2178 - protein, 39 aa, Artificial Sequence
  Computer-generated peptide variant
RLKMMSKMWRFWRKGALLFAKVVKAITLACADAVARLKD

SEQ ID NO: 2179 - protein, 22 aa, Artificial Sequence
  Computer-generated peptide variant
FIKILKKLMKLIRRLRLKKAHA

SEQ ID NO: 2180 - protein, 28 aa, Artificial Sequence
  Computer-generated peptide variant
FLRILKKLLRRMKSNVARFHNRLGELAA

SEQ ID NO: 2181 - protein, 28 aa, Artificial Sequence
  Computer-generated peptide variant
RWRLMTRFLKRLNSALPTRKFLALNIRH

SEQ ID NO: 2182 - protein, 44 aa, Artificial Sequence
  Computer-generated peptide variant
RMKMLRKLLKMYSRLRQLGSLPRFSAKVALKRLMLELDSTKGLL

SEQ ID NO: 2183 - protein, 58 aa, Artificial Sequence
  Computer-generated peptide variant
KLRWWKKFLRKLKCPWKWRVTAADKRRCAARCDAACAAAKKKHALAMKTHCHCYWMMP

SEQ ID NO: 2184 - protein, 47 aa, Artificial Sequence
  Computer-generated peptide variant
KIRLFRRLLKWIRNHAFNLCLFLWKKRDRLDTAPAAKLVNLAQRAAT

SEQ ID NO: 2185 - protein, 80 aa, Artificial Sequence
  Computer-generated peptide variant
IYRWMKRIFKKIPKIALLRAYTRCKGSRRAAQWLRRLFATKTAKTCHHTHMRAAPLLKLRQILALNKVHLVKKRRIKLGQ

SEQ ID NO: 2186 - protein, 49 aa, Artificial Sequence
  Computer-generated peptide variant
FLRFMNRLLRRITTDAKKRVKANLTVRKLAACKTKECKKLNAQLWIGRC

SEQ ID NO: 2187 - protein, 28 aa, Artificial Sequence
  Computer-generated peptide variant
LLRLWHRFLRRFRKTIAKAAPVKRCFLL

SEQ ID NO: 2188 - protein, 32 aa, Artificial Sequence
  Computer-generated peptide variant
KFRIIQKLLKLLKKRRSTARTHAETSLIALFL

SEQ ID NO: 2189 - protein, 22 aa, Artificial Sequence
  Computer-generated peptide variant
MMRLLKKLWRLLRHARGKGLHI

SEQ ID NO: 2190 - protein, 27 aa, Artificial Sequence
  Computer-generated peptide variant
LLRMFKRIWKIYPRKARFLKNKCDALA

SEQ ID NO: 2191 - protein, 36 aa, Artificial Sequence
  Computer-generated peptide variant
RWRLWRRYWRLITRNRDRQLMIKRLPCRAAILALEL

SEQ ID NO: 2192 - protein, 36 aa, Artificial Sequence
  Computer-generated peptide variant
LLKLLNKLIKRLCTSLCIRIDLKKALSDEKLRRFPF

SEQ ID NO: 2193 - protein, 87 aa, Artificial Sequence
  Computer-generated peptide variant
KLKMMRKYLRLFTRALRLSAKATDKKALRERRAHLNERKKKGLLVAYNRLANSSLSERVLSRKLAWHDNQRKLLKHLLDIDCHTLSV

SEQ ID NO: 2194 - protein, 22 aa, Artificial Sequence
  Computer-generated peptide variant
RLRIITRLIKRYKRRAAAMYNA

SEQ ID NO: 2195 - protein, 54 aa, Artificial Sequence
  Computer-generated peptide variant
YLKWYRKLLKRLKQIVRLKKAQQLAYRTWKQRGWAEDKVYKLWAWARIALALKQ

SEQ ID NO: 2196 - protein, 46 aa, Artificial Sequence
  Computer-generated peptide variant
RMRFYKRIFRKLRKRDCKLYAFYEALLTLLRYRFLHWERGKLLQWL

SEQ ID NO: 2197 - protein, 28 aa, Artificial Sequence
  Computer-generated peptide variant
YWRLMRKLFKRLQSSLKKYRPKAWATVL

SEQ ID NO: 2198 - protein, 39 aa, Artificial Sequence
  Computer-generated peptide variant
KFKLLPRMWKRLTRKFLWAKLQARIRQEAKKARMSLWAN

SEQ ID NO: 2199 - protein, 41 aa, Artificial Sequence
  Computer-generated peptide variant
FIRLLRKWFRFLKKRGLKAGQRPKKSWAIALLMKKAECRLT

SEQ ID NO: 2200 - protein, 56 aa, Artificial Sequence
  Computer-generated peptide variant
RLRWMRKLIRLMNNRAKAMFRHGRLSAKKVNLRTLTGRSKQLLYMSNMIKRRLLMR

SEQ ID NO: 2201 - protein, 37 aa, Artificial Sequence
  Computer-generated peptide variant
RLRMLRRLFKKLKKFTKGAAKAWLWWKDSHNYARVMA

SEQ ID NO: 2202 - protein, 58 aa, Artificial Sequence
  Computer-generated peptide variant
RIRLMRRLLRRITKKKMLRHKQIRQWTERDWLRGAAYAASTGRAHEARDLPADKALRR

SEQ ID NO: 2203 - protein, 81 aa, Artificial Sequence
  Computer-generated peptide variant
WYRLFKRFLKRIRQRNLTLRLASLRWGALCALKLYAKRRSACLPKTKFKRHKMRKFAEKAERRTIAREFRHAHKKCMGRTL

SEQ ID NO: 2204 - protein, 26 aa, Artificial Sequence
  Computer-generated peptide variant
LLKWIKKLFRFLHHLGYKKEAAIARC

SEQ ID NO: 2205 - protein, 25 aa, Artificial Sequence
  Computer-generated peptide variant
KLKLFKKMMRLWRKLATLEYTMLAD

SEQ ID NO: 2206 - protein, 23 aa, Artificial Sequence
  Computer-generated peptide variant
LLKIFNRLMRKITKAPARIRFLA

SEQ ID NO: 2207 - protein, 37 aa, Artificial Sequence
  Computer-generated peptide variant
KLKLLKRILRKLKRATTAVLNPNFRAKLAHSLSVTIF

SEQ ID NO: 2208 - protein, 24 aa, Artificial Sequence
  Computer-generated peptide variant
KLRLLHRFFKKLPRALGHKAGQQL

SEQ ID NO: 2209 - protein, 39 aa, Artificial Sequence
  Computer-generated peptide variant
LIRILRRLLRKIKQLAGHEKSLVKYALTKRKQKTAATYE

SEQ ID NO: 2210 - protein, 38 aa, Artificial Sequence
  Computer-generated peptide variant
WIRYMQKFLKMWKRLRWAFRRKAKAHRAARLRSASLKA

SEQ ID NO: 2211 - protein, 60 aa, Artificial Sequence
  Computer-generated peptide variant
KMRFFRKFWRKLRNFILRMNFRKADARLYALKASKMRRYPRQMGWILLRLNYYRAAAELL

SEQ ID NO: 2212 - protein, 23 aa, Artificial Sequence
  Computer-generated peptide variant
LIKFLKKWYRLFRKQAHRDLRAA

SEQ ID NO: 2213 - protein, 41 aa, Artificial Sequence
  Computer-generated peptide variant
LWRIFRKLFKMWRRLKWSNWYAHKAALKAKKKPGLDKFLMC

SEQ ID NO: 2214 - protein, 20 aa, Artificial Sequence
  Computer-generated peptide variant
FLRLWHRFLRWFQSKKLRLG

SEQ ID NO: 2215 - protein, 20 aa, Artificial Sequence
  Computer-generated peptide variant
KLRFLRRYIRLIKHAWKCCL

SEQ ID NO: 2216 - protein, 75 aa, Artificial Sequence
  Computer-generated peptide variant
FLKYYKKYFRLIRKNKSIRILDRKKVKRKAAAMRLACMRRNCLMAADYHTKLWGKRKLQHVLKVGALYIKRAKCL

SEQ ID NO: 2217 - protein, 46 aa, Artificial Sequence
  Computer-generated peptide variant
KLRIMNRFLRKLKRRLLASKEYFKRKLANRFAGAQWWVKKGDLKAS

SEQ ID NO: 2218 - protein, 41 aa, Artificial Sequence
  Computer-generated peptide variant
RIKIFRRLLRKMKPRKRERYLAASWARLWGYRLKTELLILW

SEQ ID NO: 2219 - protein, 26 aa, Artificial Sequence
  Computer-generated peptide variant
KLRFLHRFFKRMRCMRKAALDLLECG

SEQ ID NO: 2220 - protein, 24 aa, Artificial Sequence
  Computer-generated peptide variant
RWRFFRKWYRLLRRLFLQLEACRQ

SEQ ID NO: 2221 - protein, 22 aa, Artificial Sequence
  Computer-generated peptide variant
YLKLMQRFMKKMRTQAKAKLNL

SEQ ID NO: 2222 - protein, 78 aa, Artificial Sequence
  Computer-generated peptide variant
KLKWMRRLLRRLCQPAKPTRAAAFLLASRWELKASRLVGFMCRKLQTPFKLKARGIQKDLYRKKSGLRQIMKERRKVG

SEQ ID NO: 2223 - protein, 33 aa, Artificial Sequence
  Computer-generated peptide variant
FFRLMTRWMRRLSSRKMKELKRLKLTLSLNDLA

SEQ ID NO: 2224 - protein, 20 aa, Artificial Sequence
  Computer-generated peptide variant
LFKLMRRLWKRLSRANSGKA

SEQ ID NO: 2225 - protein, 73 aa, Artificial Sequence
  Computer-generated peptide variant
KWKLIKKFWRFFCKHLKKRARERLQLRKTRRMKMVTEKAWRMRTLDAKAAHHYILTAIAEARANEKWLLLPVL

SEQ ID NO: 2226 - protein, 73 aa, Artificial Sequence
  Computer-generated peptide variant
LFKILNRWFRKYRRLATQSHAKMVARVCDKWAHLCIQYATGRLAVRAEAKRLVRRLAGVRGKKGRKRKWLALF

SEQ ID NO: 2227 - protein, 51 aa, Artificial Sequence
  Computer-generated peptide variant
KWRLYHKLWKRLKHLKLYAKKSSVAWTQCCLLWRADLLLGEKMVKLGAPLR

SEQ ID NO: 2228 - protein, 96 aa, Artificial Sequence
  Computer-generated peptide variant
RFRLFPRYFRLMRKMDFALYAAHALQASKRLSHAQKKTCKLKDRAAWRLAALKRVHLRCAYKLDAAQTARRLYLKWPARHFIFKMGRVHRALMSQQ

SEQ ID NO: 2229 - protein, 25 aa, Artificial Sequence
  Computer-generated peptide variant
LLKFLRKMYKRFQRAFWLELTARLL

SEQ ID NO: 2230 - protein, 41 aa, Artificial Sequence
  Computer-generated peptide variant
KFRWLTRLYRLLKPAEDKGALWKWKSNRLAAPDRTRAKNRL

SEQ ID NO: 2231 - protein, 69 aa, Artificial Sequence
  Computer-generated peptide variant
FLRMIRKFLRRFKKVLRKRKTDYAYRKTLAARCCLAHAAEVAARQAYMMKAVPIKAAWGLNLLFARRFD

SEQ ID NO: 2232 - protein, 76 aa, Artificial Sequence
  Computer-generated peptide variant
KIRFFRRFIRLWKRYYHKLRLDQLADARKRLAAANCANYRALAAMVDAHKAQRDDPAKTCRARCANDTGRLEVRRA

SEQ ID NO: 2233 - protein, 21 aa, Artificial Sequence
  Computer-generated peptide variant
MFRLWRRYLKRWKHKAAQQDL

SEQ ID NO: 2234 - protein, 25 aa, Artificial Sequence
  Computer-generated peptide variant
KLRLWHRMLKRLRSLFIRAADSKHL

SEQ ID NO: 2235 - protein, 74 aa, Artificial Sequence
  Computer-generated peptide variant
RYRLFSRYIKRITRRFHCGRANILLKKALRRHIRAMMARKMAAWRAEIALNRKLALTGLMERKVADKTKHKKAP

SEQ ID NO: 2236 - protein, 76 aa, Artificial Sequence
  Computer-generated peptide variant
KLKWFKKMLRKLKQEWLRRRLALASHLKLSCAYARRRPMNLDATAKETYRRLFWYAKVAHWRKDRLFMSMWKAGRI

SEQ ID NO: 2237 - protein, 41 aa, Artificial Sequence
  Computer-generated peptide variant
LMRFFKRFWKIIKTRTVSYRAGKRLAKAKQHARPKRLLAPL

SEQ ID NO: 2238 - protein, 43 aa, Artificial Sequence
  Computer-generated peptide variant
MLKFLPKLFKRFCCKKCILLVIMQKLALKRQYSARAKRTRAQH

SEQ ID NO: 2239 - protein, 86 aa, Artificial Sequence
  Computer-generated peptide variant
RIKLLCKMWKKMKKQYAKYLSEMKAKSLPMRLRRLKKKPLKKYALKYAALFVRGHAAALRKPMACISQFCVLSKTDHQLKRLWAIR

SEQ ID NO: 2240 - protein, 46 aa, Artificial Sequence
  Computer-generated peptide variant
KLRLFRKFIRKFKTALYKIWKARTKRTLKNWLALRVYYLAVMLRSH

SEQ ID NO: 2241 - protein, 34 aa, Artificial Sequence
  Computer-generated peptide variant
FLRLLPKWLRKWQKTCAKFEAGRKAALANNPLSE

SEQ ID NO: 2242 - protein, 29 aa, Artificial Sequence
  Computer-generated peptide variant
IWRIWRRLLRLLKCGALKWALHVNKAKSY

SEQ ID NO: 2243 - protein, 54 aa, Artificial Sequence
  Computer-generated peptide variant
RLRFFQRMMRRLQCASNAVLMKPRLARKAESIRLLKRADVKACKRMLLEHYTKE

SEQ ID NO: 2244 - protein, 77 aa, Artificial Sequence
  Computer-generated peptide variant
RYKMMPKFFKKLNSAAIVALKACDMRDAQRGLHYAILQKFNREHLHKARCLRRALIRRKHARKATAAHPYLKKAKLY

SEQ ID NO: 2245 - protein, 31 aa, Artificial Sequence
  Computer-generated peptide variant
RLRFFHRLMKKLKTSAARTRRETKANPIAYL

SEQ ID NO: 2246 - protein, 45 aa, Artificial Sequence
  Computer-generated peptide variant
YLRILKRFYKYYRQLVLLPRRHRALRAKIIAGAQMAANRHAEHAA

SEQ ID NO: 2247 - protein, 25 aa, Artificial Sequence
  Computer-generated peptide variant
LFRFFRRLLRRLCQIWAQNKGRKLI

SEQ ID NO: 2248 - protein, 21 aa, Artificial Sequence
  Computer-generated peptide variant
LFKLLQKMLRYWRKACTLHKR

SEQ ID NO: 2249 - protein, 46 aa, Artificial Sequence
  Computer-generated peptide variant
RIRFMKRLFKIMHRARACPAAWRTVLDRRRTLTWNLVKKRALARAM

SEQ ID NO: 2250 - protein, 34 aa, Artificial Sequence
  Computer-generated peptide variant
MWKYMRRWYKKLHHAASLRWLDAFLKWMKAKRLA

SEQ ID NO: 2251 - protein, 24 aa, Artificial Sequence
  Computer-generated peptide variant
RIKLLRRWLKRLSSRLHKGVPAEA

SEQ ID NO: 2252 - protein, 32 aa, Artificial Sequence
  Computer-generated peptide variant
LMKFYSKWWKMLKTALAARAKRRPKDARKWAQ

SEQ ID NO: 2253 - protein, 20 aa, Artificial Sequence
  Computer-generated peptide variant
LWRLLHKIFKRYKRGILVKL

SEQ ID NO: 2254 - protein, 21 aa, Artificial Sequence
  Computer-generated peptide variant
KYKYMPKLMRLINKKLSRACA

SEQ ID NO: 2255 - protein, 50 aa, Artificial Sequence
  Computer-generated peptide variant
KLKYMRRIMKKLRCAATFVLLHKRLYLRKALTAAPKLAHAQLRRPKANDY

SEQ ID NO: 2256 - protein, 63 aa, Artificial Sequence
  Computer-generated peptide variant
LIRLMRKMLKKLKQTKCAKSVIRAEHCPLYYLKNKLQRRAMANACKKLRWKRGQVTIELRAEA

SEQ ID NO: 2257 - protein, 70 aa, Artificial Sequence
  Computer-generated peptide variant
FFRLLSRWFKRLRRANIQLELKLAARKLHKYDHKEAQMAQAKLHHNQMMRKLKGVKGNKRAKKRLPFETR

SEQ ID NO: 2258 - protein, 52 aa, Artificial Sequence
  Computer-generated peptide variant
YLRLFRRFLRKIRPLRGRGHKYQVNKLRRPARAIIWTGIFVKLKALFVKALA

SEQ ID NO: 2259 - protein, 45 aa, Artificial Sequence
  Computer-generated peptide variant
FWRFLRKFFKLYRSVDAHRLSRKRRFVHKKRKLNQALPAFEAAVA

SEQ ID NO: 2260 - protein, 33 aa, Artificial Sequence
  Computer-generated peptide variant
KMKLFKRFMRKIKRDGFSWLMAARARPAQAVLA

SEQ ID NO: 2261 - protein, 39 aa, Artificial Sequence
  Computer-generated peptide variant
KFKMLKKMFRKFKRLRVYMLVLEKKYLLELADLTLKMAL

SEQ ID NO: 2262 - protein, 64 aa, Artificial Sequence
  Computer-generated peptide variant
KFRFWCRLFKKYRHRKMLEQKLEARKMRVLAKAVTKIRYMAKRLGLKHMACLRDHLLNLDYKAR

SEQ ID NO: 2263 - protein, 58 aa, Artificial Sequence
  Computer-generated peptide variant
YLKIFKKILKLLPKRAPAKSKRKVKKLALFALKLCWRQPPVMLGNVCAESRHRRLLYM

SEQ ID NO: 2264 - protein, 29 aa, Artificial Sequence
  Computer-generated peptide variant
KFKLFTKILRRIKQLPAARMVELLKAKLR

SEQ ID NO: 2265 - protein, 63 aa, Artificial Sequence
  Computer-generated peptide variant
LIKMYQKFYRKMKRLTALSKLNLLQLNARLAPSALNMIMARKAIAEVRLNKICNDVRKAAAFR

SEQ ID NO: 2266 - protein, 67 aa, Artificial Sequence
  Computer-generated peptide variant
RLKWFCKLYKRWKKKWGPLPMLLLRYKHLAKSLLIRFLALKFYADSTTMADLDRKRLCKKYGKPWLM

SEQ ID NO: 2267 - protein, 99 aa, Artificial Sequence
  Computer-generated peptide variant
RLRYLRKLIKLLCTMKSWLKVNLYMYKLANWRAAANFANLQTYWKKKPECLGFAKLRKKTALFTKLKAKWKYAVKKVLQLRLWLLLKAMLFHCQNAVFC

SEQ ID NO: 2268 - protein, 41 aa, Artificial Sequence
  Computer-generated peptide variant
FLRLYNKMFRLWKKAGKKHRARVKCHCRKPLSRACILTLCL

SEQ ID NO: 2269 - protein, 40 aa, Artificial Sequence
  Computer-generated peptide variant
KYRWLKRLLKLFCKKAWLLCARKQDLARGTRLRAFAFYMK

SEQ ID NO: 2270 - protein, 20 aa, Artificial Sequence
  Computer-generated peptide variant
FLRLLRRFMRLFTKANCKAK

SEQ ID NO: 2271 - protein, 58 aa, Artificial Sequence
  Computer-generated peptide variant
LMKLLKRLIRRLTHTAWKAMGKKIYLKLDSSNLRRKAARKMAMSVVKIKKNLKWMRNH

SEQ ID NO: 2272 - protein, 32 aa, Artificial Sequence
  Computer-generated peptide variant
LYRLLRRWIRRYSRAFLKTLEDRLAYMRWTAF

SEQ ID NO: 2273 - protein, 44 aa, Artificial Sequence
  Computer-generated peptide variant
KLKMIRRMMRWLTRLPRLAFLLGIRLKIISGGRAVELRDLLRTA

SEQ ID NO: 2274 - protein, 34 aa, Artificial Sequence
  Computer-generated peptide variant
KFRLWKRLWRLLKRRLNTLWQPLVLTTCYFMKLA

SEQ ID NO: 2275 - protein, 68 aa, Artificial Sequence
  Computer-generated peptide variant
FLRMINRIMRLLRKAKLAPRLLIECAREPQKVTKLCATLLKLAHAALFFEWCHAQETAHRDKLKKSLK

SEQ ID NO: 2276 - protein, 52 aa, Artificial Sequence
  Computer-generated peptide variant
RIRWLPRLLKWLCNLDRKLAPAQKLKFTAPATAGDRCRARNEKPATPKHLLF

SEQ ID NO: 2277 - protein, 75 aa, Artificial Sequence
  Computer-generated peptide variant
KFRWYNKIFKRWKKCKRRKRTAPAGAALLAKKAIKADKWAKITDTAKAAALANAAGKDKLNGSALALKMAAKNFY

SEQ ID NO: 2278 - protein, 74 aa, Artificial Sequence
  Computer-generated peptide variant
RYKYYKKLFKRMRSHRADLRMCRIEKCWRLRLAAALLRKRSLGLVCLSARERTRKGTKRASLRDAMIYKALSGG

SEQ ID NO: 2279 - protein, 37 aa, Artificial Sequence
  Computer-generated peptide variant
RLKLIKRLFKLIHHVLVQCKLIAILAANLQKKEWRWL

SEQ ID NO: 2280 - protein, 45 aa, Artificial Sequence
  Computer-generated peptide variant
FYRLYCKLLRWLKKMKAKPRDWPATHRYLARRCAATLGRVVTKLD

SEQ ID NO: 2281 - protein, 38 aa, Artificial Sequence
  Computer-generated peptide variant
RLKLFKKWWKLINSLYPRLDLNKNFALHYKTLLCKALH

SEQ ID NO: 2282 - protein, 98 aa, Artificial Sequence
  Computer-generated peptide variant
WFRLWHKILKLLRRYELFKRKRRNCMILYNKIAMLNFARRARLFAWVKLLFRKDPAAPIAACGMAPCLLAHCAFLKLRLIFLHLRKFMVKKYKLKKQK

SEQ ID NO: 2283 - protein, 75 aa, Artificial Sequence
  Computer-generated peptide variant
KFRLIKKLFRKMKKLAINIRKAARAPLEFKGYALAWLVLRELYGLGNALPPKRTTCARRDQELILHAVAKLWDDL

SEQ ID NO: 2284 - protein, 26 aa, Artificial Sequence
  Computer-generated peptide variant
KLRIFKRLWRLLKKRTALADNMLMFK

SEQ ID NO: 2285 - protein, 52 aa, Artificial Sequence
  Computer-generated peptide variant
KLRMFPRIYRIIHPKVRIRLSAPLLERARCSAPLKANVASLKDYRKWAKKLK

SEQ ID NO: 2286 - protein, 29 aa, Artificial Sequence
  Computer-generated peptide variant
RIRLIQRLFRIMKNRSTLPKRPAAAASKQ

SEQ ID NO: 2287 - protein, 87 aa, Artificial Sequence
  Computer-generated peptide variant
LLRFMRKMLRRLRSATRKVLGHALRRCNMCRSAAELQPQKLIARRKLRRLCRWRALVRKCAMGDAEAERKDYHPKALKLKREYKDGR

SEQ ID NO: 2288 - protein, 38 aa, Artificial Sequence
  Computer-generated peptide variant
FLRMLKKLLKKIKRPCAHLWLHRNILWQRNTLAQQTAL

SEQ ID NO: 2289 - protein, 30 aa, Artificial Sequence
  Computer-generated peptide variant
LFRWFNKLLRRWRRHTKLAQKSLLSTKELM

SEQ ID NO: 2290 - protein, 43 aa, Artificial Sequence
  Computer-generated peptide variant
MMKLYCRYLKYYPRAIPLRKKDWASAKTLNKNQKLLSRKRDAK

SEQ ID NO: 2291 - protein, 29 aa, Artificial Sequence
  Computer-generated peptide variant
KLKMIKRWFRLLHSFVKARAKLCTMHRAC

SEQ ID NO: 2292 - protein, 98 aa, Artificial Sequence
  Computer-generated peptide variant
KLKYFKKFIRLYRKSEMHSRAKGGAKVAARKGMAWRASNEAPCLWKLCCALKRNRRKWIYKMFRFRGDAARVRRAKRKYGARRKLEDLVAGLKLELEM

SEQ ID NO: 2293 - protein, 44 aa, Artificial Sequence
  Computer-generated peptide variant
KMRWLHRYWKLLKKDRDCKGALLLKWRYYNLHYQLRCYAKLKPK

SEQ ID NO: 2294 - protein, 53 aa, Artificial Sequence
  Computer-generated peptide variant
RFRWWKRLFRFLKCAQVSRAEKGLVKQWLLKALKPRNRAKVARALIAVVFLKN

SEQ ID NO: 2295 - protein, 32 aa, Artificial Sequence
  Computer-generated peptide variant
LFRWLSRLFRFFHTYARRKSWTARAKWRLKLH

SEQ ID NO: 2296 - protein, 39 aa, Artificial Sequence
  Computer-generated peptide variant
RIKLLCRLLRRMKKEDLDPGMAQRRSKQAKLVRLILMYG

SEQ ID NO: 2297 - protein, 87 aa, Artificial Sequence
  Computer-generated peptide variant
IWRYLKKLFKKIKKGHPASVMCDSKRLLLRARRIKDFHAKKKCKASDYNLAAKAAAKRHHKKTQRARRMCAWQMPVVKMAEAKYILR

SEQ ID NO: 2298 - protein, 41 aa, Artificial Sequence
  Computer-generated peptide variant
LFKILSRLYRLLRKQRFLQLKASARLKRYHRTSLNTLKELF

SEQ ID NO: 2299 - protein, 69 aa, Artificial Sequence
  Computer-generated peptide variant
KMRLIKKLFKYLKPDRAGGSKINKKLVKKLSMLKLRLNKCDRKMAMAPMRARGCAATGAWLKTMETSKK

SEQ ID NO: 2300 - protein, 33 aa, Artificial Sequence
  Computer-generated peptide variant
YLKLFKKLLKFFRRQAPKLPEAYPYACRQELLA

SEQ ID NO: 2301 - protein, 27 aa, Artificial Sequence
  Computer-generated peptide variant
RMRLMCKWLKWLQKRHTLALERRRAKL

SEQ ID NO: 2302 - protein, 49 aa, Artificial Sequence
  Computer-generated peptide variant
KFKMFRKYLRKFKKRDYKCRAAMACTKRLHLSATAYLRDVIMMAAKLWK

SEQ ID NO: 2303 - protein, 58 aa, Artificial Sequence
  Computer-generated peptide variant
KIRLLKRLWRKLRSIKKRPQAKYPKAALKDDIAIDELRALKRSHPLCVERKGNGHLHG

SEQ ID NO: 2304 - protein, 43 aa, Artificial Sequence
  Computer-generated peptide variant
KLRIFRRLLRRLRQKALKQLRLDDAVADRAGHAKRKIHKAMRV

SEQ ID NO: 2305 - protein, 26 aa, Artificial Sequence
  Computer-generated peptide variant
RLRMFRRLIKRFRSPAESLLFEQLAA

SEQ ID NO: 2306 - protein, 26 aa, Artificial Sequence
  Computer-generated peptide variant
LIKLIRRLMRLWKKAAYLQINNVRDR

SEQ ID NO: 2307 - protein, 33 aa, Artificial Sequence
  Computer-generated peptide variant
FLRLYKRLLKMMKPTKSSVLARCALCKANGLDA

SEQ ID NO: 2308 - protein, 32 aa, Artificial Sequence
  Computer-generated peptide variant
RLRFYQKMLKWLQRFVKMPASAAKMRVKMLKA

SEQ ID NO: 2309 - protein, 41 aa, Artificial Sequence
  Computer-generated peptide variant
KLKFFPRILRFFSRKKYRLYRRGLEADSSALKARARLIFNV

SEQ ID NO: 2310 - protein, 21 aa, Artificial Sequence
  Computer-generated peptide variant
KLRFFTKLLKWFKQACLKIRV

SEQ ID NO: 2311 - protein, 23 aa, Artificial Sequence
  Computer-generated peptide variant
RLKWMTRWIKLLNRKLNGQKLLE

SEQ ID NO: 2312 - protein, 20 aa, Artificial Sequence
  Computer-generated peptide variant
KIRLWCRLWRLLKNQLGLRL

SEQ ID NO: 2313 - protein, 48 aa, Artificial Sequence
  Computer-generated peptide variant
LMKMFCRLLRYYNKKDTLQAGCAARANWFRKLLAPSYRALARNRLQAK

SEQ ID NO: 2314 - protein, 33 aa, Artificial Sequence
  Computer-generated peptide variant
FIKLLRKLIKKWRKHEAKFRMRGWAAALKGPHL

SEQ ID NO: 2315 - protein, 49 aa, Artificial Sequence
  Computer-generated peptide variant
KWRFWKRMIKYFKKALAFVEARRQGFATSAKLRKKLARAVLNVATKNAR

SEQ ID NO: 2316 - protein, 72 aa, Artificial Sequence
  Computer-generated peptide variant
KLKIYRRLLRYLRSHFRKFKLAGHCWPAERVARKARYKLDTQAWLKNTKGKRLMLAGLRLKCCILRDDHNRH

SEQ ID NO: 2317 - protein, 29 aa, Artificial Sequence
  Computer-generated peptide variant
FYKLLKKWLKILRTKWKTCALDQKKKALD

SEQ ID NO: 2318 - protein, 66 aa, Artificial Sequence
  Computer-generated peptide variant
FFKLMTRLWKWLKRTKAKQARASKAKHDLYLRQMQAKREVKYALRIYKTSKAAYMVSAKNLLKLYA

SEQ ID NO: 2319 - protein, 55 aa, Artificial Sequence
  Computer-generated peptide variant
RYRLFRKYLRLLKRLYYNDRMFLKKAVKAWKWVALVLAFPARCQRAQRDFGLMRK

SEQ ID NO: 2320 - protein, 31 aa, Artificial Sequence
  Computer-generated peptide variant
RLRLFTRLFRKFHNARDLIAAKAKSLKLEVL

SEQ ID NO: 2321 - protein, 69 aa, Artificial Sequence
  Computer-generated peptide variant
KFKLYNKFLRLFRRLSLFHARDRAARRARDATRLNGHAKPLNKKANWTKTVTLNWCAVQYKRLKRLLPW

SEQ ID NO: 2322 - protein, 50 aa, Artificial Sequence
  Computer-generated peptide variant
LLKLLQRWFKRWTRDIRRHCRANKERELRLRRLIFHMLALLILAAAFHAR

SEQ ID NO: 2323 - protein, 74 aa, Artificial Sequence
  Computer-generated peptide variant
IFKFIPRLMRLMKKVLFRFRPLYANAVRARNMKAVLLRKAALSKRALNIMDWRSKLRKEKLLLIMYQGFRRAKG

SEQ ID NO: 2324 - protein, 30 aa, Artificial Sequence
  Computer-generated peptide variant
LWRLWKKWFRRFHTKLAKLLKFKRGHRAAT

SEQ ID NO: 2325 - protein, 37 aa, Artificial Sequence
  Computer-generated peptide variant
ILRFLQRLLKFFTKKRKVARLGEMNKREFLAFMSLAK

SEQ ID NO: 2326 - protein, 38 aa, Artificial Sequence
  Computer-generated peptide variant
RYKLLKRIMRLIKRKQKAGQLKIGRLAAGANDLHHYDW

SEQ ID NO: 2327 - protein, 40 aa, Artificial Sequence
  Computer-generated peptide variant
FLKFIKKFWRKLNKKKKIPTPSLLNKLSLSRLWASASRYA

SEQ ID NO: 2328 - protein, 35 aa, Artificial Sequence
  Computer-generated peptide variant
RMRLMTKWLKKIQRKHLLLRASAKINNMLFQAARQ

SEQ ID NO: 2329 - protein, 34 aa, Artificial Sequence
  Computer-generated peptide variant
FLRLFRKLLKMLKPGHKSQSTVARRLALADKAQY

SEQ ID NO: 2330 - protein, 30 aa, Artificial Sequence
  Computer-generated peptide variant
KMRFLKKYFKWICKMLHAKANLKAMVTKKA

SEQ ID NO: 2331 - protein, 21 aa, Artificial Sequence
  Computer-generated peptide variant
LLKFLCRMLRRYKKHKALMTH

SEQ ID NO: 2332 - protein, 32 aa, Artificial Sequence
  Computer-generated peptide variant
RFRLYRRLLRRIHQSLPARAKHRATLVRNARL

SEQ ID NO: 2333 - protein, 49 aa, Artificial Sequence
  Computer-generated peptide variant
LLRIMPRWYKRLKKRYSKATALRRWLCGAAMRLRAQRMAKEWHETIMRL

SEQ ID NO: 2334 - protein, 76 aa, Artificial Sequence
  Computer-generated peptide variant
RYKLLSKIWKKMNTQASLPLQKRRRAKHALAARGAKLHPFLREAKLTYLIPLDAKAKYKVASGWLNQARVMWAYRR

SEQ ID NO: 2335 - protein, 43 aa, Artificial Sequence
  Computer-generated peptide variant
LIKMLKRYLKLLRRGGACRATPAARLSKKRGYMQRVLSTRRQC

SEQ ID NO: 2336 - protein, 29 aa, Artificial Sequence
  Computer-generated peptide variant
KLKFYKRMFKFFKKAIHSLLAKLSRAGKA

SEQ ID NO: 2337 - protein, 50 aa, Artificial Sequence
  Computer-generated peptide variant
KFKYYCKIFKYFPRHLKVAKDKKIKLRILLERWRALLKVKWVHSHLALKL

SEQ ID NO: 2338 - protein, 41 aa, Artificial Sequence
  Computer-generated peptide variant
RLKLMRKMMKFYRRLLHDTLAKNAAMFRAILQRPVNKLASC

SEQ ID NO: 2339 - protein, 80 aa, Artificial Sequence
  Computer-generated peptide variant
RYRLMRKLLKILRRLALAPRHPDNCFHCKKQRQLPRSKKKWAKPRQFNCENYRAKLPARVLFARKSRGSDARMTYLHALL

SEQ ID NO: 2340 - protein, 76 aa, Artificial Sequence
  Computer-generated peptide variant
RFKMLRRFYKKFKKKAKWPLKLHGQKLTLLTARGLLRKRYKLLAKNKTNPWTSLAHALRRKGAQHKGEHLAKDLAN

SEQ ID NO: 2341 - protein, 25 aa, Artificial Sequence
  Computer-generated peptide variant
YYKMWRRFIRRLRKAFKNALNLPAY

SEQ ID NO: 2342 - protein, 30 aa, Artificial Sequence
  Computer-generated peptide variant
RLKILRKFLKMFRSALTNMKYAGCYKIRAR

SEQ ID NO: 2343 - protein, 40 aa, Artificial Sequence
  Computer-generated peptide variant
KYKYLQKFLRKMRCMSIDREKPLLTAFIKRLSAALGARAD

SEQ ID NO: 2344 - protein, 42 aa, Artificial Sequence
  Computer-generated peptide variant
MLRLLKRYLKLFCTIRNHRPLWRLKQKKKLAKAVCDKLQPTY

SEQ ID NO: 2345 - protein, 28 aa, Artificial Sequence
  Computer-generated peptide variant
LWRLFRKLMKRYCKWEKVKWLNPLTKLA

SEQ ID NO: 2346 - protein, 84 aa, Artificial Sequence
  Computer-generated peptide variant
RFKFMKKMLRRLCRLVMSRAQKAMVAKCFGRKLCLAQPTLGRRSTLKLIKKKHICLLRLKAWKKLVKLYLQKSLWYQKTRIFKT

SEQ ID NO: 2347 - protein, 75 aa, Artificial Sequence
  Computer-generated peptide variant
YIRLFRRFLRLFRQTRLCAYRALLTGAALKRWMAALCRQKRRPRAMTAHKQKYKTLRLELSRMCRDRHAKVYTDH

SEQ ID NO: 2348 - protein, 38 aa, Artificial Sequence
  Computer-generated peptide variant
IFRLLRKFYKKLKKKERIPHLRYELLASKAWLMLLLKC

SEQ ID NO: 2349 - protein, 41 aa, Artificial Sequence
  Computer-generated peptide variant
KFKLFKRYLRKFRKRAALLNHARVPKACLNHYEAKEKFVEA

SEQ ID NO: 2350 - protein, 70 aa, Artificial Sequence
  Computer-generated peptide variant
FLRLYKKILRKLCTQAMKRPINWLISSLNLKTKKVRRRRSARPWLKEKARAFQWIWWLRLRHLRMRAINR

SEQ ID NO: 2351 - protein, 73 aa, Artificial Sequence
  Computer-generated peptide variant
LYRYFNKLIKIMPKRRKLVWLLKKRKRKRGRLLVSVLPPHMLARLEKYQDLHKKDWLALLFRKAFGKYRCQWL

SEQ ID NO: 2352 - protein, 37 aa, Artificial Sequence
  Computer-generated peptide variant
WYRFMRKILKLLSNLLVKFNLAKKAAKFYKLKQRREP

SEQ ID NO: 2353 - protein, 63 aa, Artificial Sequence
  Computer-generated peptide variant
WLKFFSKFYRKWNKLKEQFKKRAYAETLLAFALRRKAQALGLRRELQFNQDRILGEKARKLAV

SEQ ID NO: 2354 - protein, 27 aa, Artificial Sequence
  Computer-generated peptide variant
RFKFLRKLMKYIPKAIALKKFLFKKLL

SEQ ID NO: 2355 - protein, 74 aa, Artificial Sequence
  Computer-generated peptide variant
RFRLWSRMFRILKRHLRLRYKYKERKIRYGFRYTLKPLWFATLAWDLKANRAQIAHKLCISQRSLNLKALRRKA

SEQ ID NO: 2356 - protein, 70 aa, Artificial Sequence
  Computer-generated peptide variant
KLRYWRKWFRRFPNMAAPKRAKLAILGRRKRWKNPGKASTLRLLTIPHQLEINKVRLKIKYKLKALAQRK

SEQ ID NO: 2357 - protein, 48 aa, Artificial Sequence
  Computer-generated peptide variant
FFRLWKKIFRWLPKARMAPHAFFLAGRARDKIYLLARYLCLRRKSTAG

SEQ ID NO: 2358 - protein, 35 aa, Artificial Sequence
  Computer-generated peptide variant
ILKILKKLMRKLHQAWHWALRRRTGKAHADRMEPK

SEQ ID NO: 2359 - protein, 44 aa, Artificial Sequence
  Computer-generated peptide variant
WLRYWNKYFKRLRPCCDLAADLKERCLGMRDPKRLFAKLLKHLR

SEQ ID NO: 2360 - protein, 43 aa, Artificial Sequence
  Computer-generated peptide variant
ILRFLRRLMRLFTRSALEMRNRLCGRARRLGYWSILLHPYKAL

SEQ ID NO: 2361 - protein, 40 aa, Artificial Sequence
  Computer-generated peptide variant
RLKLYNKFLKLWKRMGLPRHNKVRDCTTALKDKWKLCSLK

SEQ ID NO: 2362 - protein, 35 aa, Artificial Sequence
  Computer-generated peptide variant
RMKLWKRWMKLLKPQKLSILKIKKAAKLARQLNRE

SEQ ID NO: 2363 - protein, 21 aa, Artificial Sequence
  Computer-generated peptide variant
YMKILRKLLKRFKRMSAQMAT

SEQ ID NO: 2364 - protein, 53 aa, Artificial Sequence
  Computer-generated peptide variant
RIRFFPRMFKLIRKKNLRLYRLKQILALNLANVADDWKKAQHAKLGSKLLSRN

SEQ ID NO: 2365 - protein, 99 aa, Artificial Sequence
  Computer-generated peptide variant
RFKYYRRLLKLIKKGARCCRLPRLRKLNLMAREGCLDMYRGLNSIAILAAPWARLFLRQRRSQRWDLKRNLEKASVAPRARERRMVCKLYIFQLALLRF

SEQ ID NO: 2366 - protein, 44 aa, Artificial Sequence
  Computer-generated peptide variant
FLRLYSRWFKLLRCAAAKARRQIKKRIHRLYACDALCNVKSIRN

SEQ ID NO: 2367 - protein, 30 aa, Artificial Sequence
  Computer-generated peptide variant
RFRLLRRMWRFFRNHLAALLERIRMKLLWA

SEQ ID NO: 2368 - protein, 75 aa, Artificial Sequence
  Computer-generated peptide variant
RLKFLTRWIRRFKRHLVIAAAAWAAHQGRRNVKPMLRLRSRFFAGLRKFARIDADLRRSKKALRGDRAAATLGIK

SEQ ID NO: 2369 - protein, 26 aa, Artificial Sequence
  Computer-generated peptide variant
RFRLMTRFFRKIKSALKRGSKTALLA

SEQ ID NO: 2370 - protein, 38 aa, Artificial Sequence
  Computer-generated peptide variant
FLKLFSKMYRKIKRGLKRLAKQLAPEKSWENIWTLLLK

SEQ ID NO: 2371 - protein, 22 aa, Artificial Sequence
  Computer-generated peptide variant
LYKLLNRIWRKLRRAIDLAAAK

SEQ ID NO: 2372 - protein, 20 aa, Artificial Sequence
  Computer-generated peptide variant
WLRYLRKWLKYLQKEANRFH

SEQ ID NO: 2373 - protein, 54 aa, Artificial Sequence
  Computer-generated peptide variant
RMKFFQKMYKWFKQLAARAHLVRDLRALELLYQALNLIQKWGHSRKKIKALLLF

SEQ ID NO: 2374 - protein, 39 aa, Artificial Sequence
  Computer-generated peptide variant
WLRLLRRIMKRLRSSLMGARRHWASRLRALLCKAVKRVS

SEQ ID NO: 2375 - protein, 86 aa, Artificial Sequence
  Computer-generated peptide variant
LLKLFKRLFKKYRRRRARHRYNPVNKAQMSVVRKLERSLYSARRSGALAWKLKKMRWLAKDKELQCHAFLRRLLQNCQSSLRTATR

SEQ ID NO: 2376 - protein, 75 aa, Artificial Sequence
  Computer-generated peptide variant
RWRLIKKFYRKLRKNYLRLKNIRQYKSREPRMWKRPLLRKLCYGLGRLAALAEWKLNTMSKQNAYTTLLQMAAAL

SEQ ID NO: 2377 - protein, 29 aa, Artificial Sequence
  Computer-generated peptide variant
KLKIMRRMLRYIKRMVQLKALALACYSQK

SEQ ID NO: 2378 - protein, 21 aa, Artificial Sequence
  Computer-generated peptide variant
WWKIIRRILKRLKPALLDLHP

SEQ ID NO: 2379 - protein, 28 aa, Artificial Sequence
  Computer-generated peptide variant
ILRWLRKLMKRIQHRAIRCYLAKEKAYM

SEQ ID NO: 2380 - protein, 94 aa, Artificial Sequence
  Computer-generated peptide variant
LLRLYRRMFRKFRKRRKRFAPAKLALKAMIGAKCGYKKRNNIAASRKALRRRNKLFLLKGLLMKRQIAKKLKNNHIRCQLAWAVGRGMMYANFA

SEQ ID NO: 2381 - protein, 87 aa, Artificial Sequence
  Computer-generated peptide variant
FFKWMKRILRRLNKAPTAAHSLRIRAFNEVRLRRRAKKKGHYVRLNLWRAFPVHAVRAWFLLQRWASYTPRASLADKFRAKKLMRPR

SEQ ID NO: 2382 - protein, 50 aa, Artificial Sequence
  Computer-generated peptide variant
KLRFYRRILRKYRRAREKLFTAWQERPKRKIELTLCRLCLELRARTALAS

SEQ ID NO: 2383 - protein, 58 aa, Artificial Sequence
  Computer-generated peptide variant
MYRFIKKFLRFIRPRLRCERMHKFMRRCARAAKFAYKGLARLPLMTRGKLQLLPARWL

SEQ ID NO: 2384 - protein, 23 aa, Artificial Sequence
  Computer-generated peptide variant
KFRLLKKYFKRFRRCSWAPFALL

SEQ ID NO: 2385 - protein, 78 aa, Artificial Sequence
  Computer-generated peptide variant
LFKLWHRWLRRMRKIQALLFRNDKAADCKTRLSGMSQRFLLLMANRTTARKSKFEKAVRKTLLIADRLRSAKQEDQRK

SEQ ID NO: 2386 - protein, 28 aa, Artificial Sequence
  Computer-generated peptide variant
KLKLFNKYWKKMRKHLQALVAHLTRKAM

SEQ ID NO: 2387 - protein, 20 aa, Artificial Sequence
  Computer-generated peptide variant
LIRFFKKFYKRLKTASQLDL

SEQ ID NO: 2388 - protein, 31 aa, Artificial Sequence
  Computer-generated peptide variant
KYKWWKRLLRRLHRCMRLQKYFAKYFRALAA

SEQ ID NO: 2389 - protein, 62 aa, Artificial Sequence
  Computer-generated peptide variant
KFKLLKRLIRRLPKAKEAMPEAPDRALRASDRAEDKAMMHRCCKGPRARKRMRAKAHFLMQK

SEQ ID NO: 2390 - protein, 52 aa, Artificial Sequence
  Computer-generated peptide variant
LLRMLRRLWKWWKKIVQLALHKNIKRTLCRFDDKKHSMCKLLHCELHRRKKL

SEQ ID NO: 2391 - protein, 50 aa, Artificial Sequence
  Computer-generated peptide variant
FYRFMRRMMRFMSKRLRCTRVNARKFELDNSKALAARKAATFAWLLALPL

SEQ ID NO: 2392 - protein, 58 aa, Artificial Sequence
  Computer-generated peptide variant
RFRIIRKMYRRLRKKRALALLRAAMIQAKHSDWLAKLARCCRRWLAPKILGRVKTHPL

SEQ ID NO: 2393 - protein, 55 aa, Artificial Sequence
  Computer-generated peptide variant
KFKMYRKFFKLIKSKRRDALNIARRHAMDFKAFGHLRALIKARAAWKDPEKHLLY

SEQ ID NO: 2394 - protein, 34 aa, Artificial Sequence
  Computer-generated peptide variant
FFRLWKKFLKKICKTAARFNRAAALRSKARAAYL

SEQ ID NO: 2395 - protein, 33 aa, Artificial Sequence
  Computer-generated peptide variant
LLRLLTRWFRWFKKAQAKHCGQLRHALKTLHPA

SEQ ID NO: 2396 - protein, 54 aa, Artificial Sequence
  Computer-generated peptide variant
KFRFLNRLFRKFKNKCLMRAEIRIPKCVAKSPNRWLLLKLLAWDAHQVARAALR

SEQ ID NO: 2397 - protein, 23 aa, Artificial Sequence
  Computer-generated peptide variant
LMKLFQKFLRKLKHCLHLVKFAH

SEQ ID NO: 2398 - protein, 29 aa, Artificial Sequence
  Computer-generated peptide variant
KFRLFHRILRKFPPWCASAVALKGKLART

SEQ ID NO: 2399 - protein, 37 aa, Artificial Sequence
  Computer-generated peptide variant
MFRLLRRLWRRLRKEARVGLQRLAYRYIKAAAKRAHL

SEQ ID NO: 2400 - protein, 82 aa, Artificial Sequence
  Computer-generated peptide variant
LFKWLKRLWKFMRRAKGNKDALKAKRRPAALKKRNATEGGSAEKTGEALRTKFMSMTSYKAALRYKWRQEAKKRDFRRMMAA

SEQ ID NO: 2401 - protein, 31 aa, Artificial Sequence
  Computer-generated peptide variant
KFKFIKKILKWLRKSWLPRARAKPGALKCLA

SEQ ID NO: 2402 - protein, 38 aa, Artificial Sequence
  Computer-generated peptide variant
KLKMYKKFLRRFRRFLATTLRGQRLLEEWHWQAADSKK

SEQ ID NO: 2403 - protein, 39 aa, Artificial Sequence
  Computer-generated peptide variant
LMRLLKRWIRRWKNLRAGAARMWWFTGGAKKAAYKAKFS

SEQ ID NO: 2404 - protein, 37 aa, Artificial Sequence
  Computer-generated peptide variant
LLKILKRLWKRFCKRMKKVAALGNAYKNGGELFARDQ

SEQ ID NO: 2405 - protein, 20 aa, Artificial Sequence
  Computer-generated peptide variant
KLKLMHKWIRLLSKMVADKH

SEQ ID NO: 2406 - protein, 25 aa, Artificial Sequence
  Computer-generated peptide variant
RYKLMNKLIRLIKRPLAKFRAENAI

SEQ ID NO: 2407 - protein, 41 aa, Artificial Sequence
  Computer-generated peptide variant
FLRFYKKFFRKLSRNPAARAVRNCAIKKKTVARYRCLNLLA

SEQ ID NO: 2408 - protein, 38 aa, Artificial Sequence
  Computer-generated peptide variant
LFRLMRKLYRKFNRYSLLLEKRRPLAPSARDKTMRFAV

SEQ ID NO: 2409 - protein, 30 aa, Artificial Sequence
  Computer-generated peptide variant
LLRIFKRLLRKLRHWLKMLNHPMRLPHAKK

SEQ ID NO: 2410 - protein, 51 aa, Artificial Sequence
  Computer-generated peptide variant
KWKLYKKYYRRMKKLRANQSKLSRQELFLQNCAAKHTCKILLLKLKKLCLP

SEQ ID NO: 2411 - protein, 36 aa, Artificial Sequence
  Computer-generated peptide variant
RYKLWRRYFRRLCTLMCKRADQLQKAGLWPRQLLLD

SEQ ID NO: 2412 - protein, 68 aa, Artificial Sequence
  Computer-generated peptide variant
RLKLLSRILKFFSKNIFHGRTLALALATKKLERAKATPKLRKRRRFGAKRVWDKRNMWTIKPLRSNKL

SEQ ID NO: 2413 - protein, 25 aa, Artificial Sequence
  Computer-generated peptide variant
LLKFLRKFLKLWRRKTLDMTIHSER

SEQ ID NO: 2414 - protein, 37 aa, Artificial Sequence
  Computer-generated peptide variant
KLKWIKKYLRRMRNVIARPLRVLKLCDQAKRALLKMQ

SEQ ID NO: 2415 - protein, 39 aa, Artificial Sequence
  Computer-generated peptide variant
FMRLMRRMLRMWTTLLWLRWGLKALRFYTKRAKLAKHFA

SEQ ID NO: 2416 - protein, 25 aa, Artificial Sequence
  Computer-generated peptide variant
RFRLFKRWMRKMHCHAKKSLLDPAA

SEQ ID NO: 2417 - protein, 40 aa, Artificial Sequence
  Computer-generated peptide variant
YLRIFRKILKLYCCLKQKKKQWRCAADLKMRVSALTPLPR

SEQ ID NO: 2418 - protein, 90 aa, Artificial Sequence
  Computer-generated peptide variant
KIRYLKKMMRLLRRQKHKLKDKCNLLKVAHTDKLMTLAFYKKAMTKCRAAAMALFTCKGFAYLAKQRNPTAELARDKVLHYLARWGLKRQ

SEQ ID NO: 2419 - protein, 38 aa, Artificial Sequence
  Computer-generated peptide variant
LWRWWKRFIRLFKREHRVLLLVPRKYWLLAARLNACRM

SEQ ID NO: 2420 - protein, 31 aa, Artificial Sequence
  Computer-generated peptide variant
KWRILTRLFRMYKKRKRTVNHYALLYLRLAL

SEQ ID NO: 2421 - protein, 54 aa, Artificial Sequence
  Computer-generated peptide variant
RFKWFKRMWRRIKRLRTTLFPFRLLTIRKAELRARRDAALDVALNTLLALWHRV

SEQ ID NO: 2422 - protein, 25 aa, Artificial Sequence
  Computer-generated peptide variant
LWKMIHKWFRKLKCLCALNLLSKGR

SEQ ID NO: 2423 - protein, 40 aa, Artificial Sequence
  Computer-generated peptide variant
KIKLFSRIFRFMKQLAEYAKKAMQMARAWFKNKHRAAYAL

SEQ ID NO: 2424 - protein, 24 aa, Artificial Sequence
  Computer-generated peptide variant
KLRLIRKLLKMYSSKNKHPWLLPL

SEQ ID NO: 2425 - protein, 54 aa, Artificial Sequence
  Computer-generated peptide variant
LLRFLSKFLRIFKRVLLGRRPQLAGKRFKFKRYTLKKHDLQRWASHKNYIADAL

SEQ ID NO: 2426 - protein, 29 aa, Artificial Sequence
  Computer-generated peptide variant
RFRMFTRLWKKWTQKGARKLKLAWAGLPQ

SEQ ID NO: 2427 - protein, 61 aa, Artificial Sequence
  Computer-generated peptide variant
RYKMLNRWFKFFTRAACAAPNLKIPKCDKALYLYRRKCRARDKFNALVLMTRNLKKAAKRH

SEQ ID NO: 2428 - protein, 74 aa, Artificial Sequence
  Computer-generated peptide variant
RWKFLKKLMRRIKSRLRTKNQAASVLPARERREAIEFRAELKLRTKLRQPAKGLLLRCNLRYRTKRFQLAGRKL

SEQ ID NO: 2429 - protein, 41 aa, Artificial Sequence
  Computer-generated peptide variant
LLKWLHKLFKRLRRMATAHLWGLKRLSQRIKEGKMAKMAEL

SEQ ID NO: 2430 - protein, 45 aa, Artificial Sequence
  Computer-generated peptide variant
RIKMLRRMLKKWKRPEDYLKWMLAALACDALSMRQAATYLLRARG

SEQ ID NO: 2431 - protein, 60 aa, Artificial Sequence
  Computer-generated peptide variant
MLKLIKRLLKRFKRRKQKAAQALEKWSPRPALDTYYLMKLANDRAYAKDRKQRLTRDRAK

SEQ ID NO: 2432 - protein, 30 aa, Artificial Sequence
  Computer-generated peptide variant
YWKLFPRWYKKLKRCAKLRLTRKAKLDLLC

SEQ ID NO: 2433 - protein, 64 aa, Artificial Sequence
  Computer-generated peptide variant
WWRLFKRLLKRLTRVLLRYTRKKANRRLPWLLKMEISEAKKNHRLAGKKLQVANDRKERARADA

SEQ ID NO: 2434 - protein, 20 aa, Artificial Sequence
  Computer-generated peptide variant
RMKFFKKFLKKLKNLDPMLA

SEQ ID NO: 2435 - protein, 34 aa, Artificial Sequence
  Computer-generated peptide variant
RFRFMNRLLKRFQKRWLLKFLPAMKPKLGLARLL

SEQ ID NO: 2436 - protein, 69 aa, Artificial Sequence
  Computer-generated peptide variant
FWRWLCRLLRRLRRHNDRVHLSRTDKALMLQKLDEREAQTRWMVLKGAMRRSNSKLKGIYCRALAKKLR

SEQ ID NO: 2437 - protein, 94 aa, Artificial Sequence
  Computer-generated peptide variant
RFRIIRKFLRRIHSVTLIKKMLQIWHAGFARRLLKLLAVLFGTEKLLAKKTAKMFKKEMWRRKKIRTLLAKRGDMAKQLLAWREGRLMKKRKWR

SEQ ID NO: 2438 - protein, 58 aa, Artificial Sequence
  Computer-generated peptide variant
ILKLLQKWWRFWTSASKPKMALLRKTDAFTGLLALDTRHGSLRKVAKPKAMRKLPAEK

SEQ ID NO: 2439 - protein, 72 aa, Artificial Sequence
  Computer-generated peptide variant
KLKYWKRFLRKLTSMQYLRDRFQKAQRRKLPHATEKKCAHQLLRCTNYDRYFRLRPRDALRCDLKALKPKLI

SEQ ID NO: 2440 - protein, 26 aa, Artificial Sequence
  Computer-generated peptide variant
KLRLLHKWLKFMRKCRLSTQMGRALR

SEQ ID NO: 2441 - protein, 47 aa, Artificial Sequence
  Computer-generated peptide variant
RFKFISRWLKKLKQRCKARKLGATLGYLNYRIHRRLKVAMLHTRFAF

SEQ ID NO: 2442 - protein, 28 aa, Artificial Sequence
  Computer-generated peptide variant
KMRFFQRMYRKIRKALILHLTKARMALT

SEQ ID NO: 2443 - protein, 56 aa, Artificial Sequence
  Computer-generated peptide variant
LMKYFRRLWRRMRTAKLWLLKRNLYRLPRKWAARHQLGGRRRPSRNLCAYYCTLFR

SEQ ID NO: 2444 - protein, 85 aa, Artificial Sequence
  Computer-generated peptide variant
RLKFFRRLFRFFKPALCAKATVFMKLRLCLLNPARAMRWPAKKLRIVRTLKVDFERAGYSSKRKPERNCIRARAAKGNKLIARYF

SEQ ID NO: 2445 - protein, 48 aa, Artificial Sequence
  Computer-generated peptide variant
RLRFLCKFFRLLCKRKAEKLNLDNAPFLADDPRRARRIKVFRSTRLFC

SEQ ID NO: 2446 - protein, 38 aa, Artificial Sequence
  Computer-generated peptide variant
LWKWFSRLLKRLRRPDKIALYARALSEKRLGAFREQRW

SEQ ID NO: 2447 - protein, 57 aa, Artificial Sequence
  Computer-generated peptide variant
LIKIFKKIWRRMQKSKNDLPYKKMLWARAYRRKAKQCYAKPLYLKLARLLHFRRWYL

SEQ ID NO: 2448 - protein, 23 aa, Artificial Sequence
  Computer-generated peptide variant
KWKLLKRIIKKLKHDNAALKQPP

SEQ ID NO: 2449 - protein, 40 aa, Artificial Sequence
  Computer-generated peptide variant
KYKLLRRFWKLFRKNRVRALQCPPLLLKKSAPMKLFDMRQ

SEQ ID NO: 2450 - protein, 46 aa, Artificial Sequence
  Computer-generated peptide variant
KYRFMRRMLRRLQRAYRHRACDRGRSAHNLCANRRKLALGAFKDAY

SEQ ID NO: 2451 - protein, 40 aa, Artificial Sequence
  Computer-generated peptide variant
KIKLLKRIWRRWKQIKAYHRARVARPRILAAPKAYKAYVI

SEQ ID NO: 2452 - protein, 72 aa, Artificial Sequence
  Computer-generated peptide variant
MLRWLKRMFRKFNKRKLILQRALKVRELMWLWDLAAMNRRVARRRLNRMDAARKKDWRMHSCLLFTVRLIRR

SEQ ID NO: 2453 - protein, 38 aa, Artificial Sequence
  Computer-generated peptide variant
LFKLWHRLLRMLRRRCNKKAALKRDVVQKRSGFEHYLI

SEQ ID NO: 2454 - protein, 41 aa, Artificial Sequence
  Computer-generated peptide variant
KLKILKKFFRFWHKKKLVADKCWCPSELLPLRAHAAACLIL

SEQ ID NO: 2455 - protein, 27 aa, Artificial Sequence
  Computer-generated peptide variant
KLRFMKRWLKKLRKSLAPSRSASNLLA

SEQ ID NO: 2456 - protein, 33 aa, Artificial Sequence
  Computer-generated peptide variant
LMKLWPRLLKIFKPKLKHNLTRGKIIAWEALKL

SEQ ID NO: 2457 - protein, 22 aa, Artificial Sequence
  Computer-generated peptide variant
LMKLLRRLLKKLTQLLPRDTVK

SEQ ID NO: 2458 - protein, 36 aa, Artificial Sequence
  Computer-generated peptide variant
KFKLFCRMIRLLHKRGRALQMLRKKANFLWRSARNL

SEQ ID NO: 2459 - protein, 24 aa, Artificial Sequence
  Computer-generated peptide variant
IMRFLRRLLRMLQPRSLTRRDLDL

SEQ ID NO: 2460 - protein, 43 aa, Artificial Sequence
  Computer-generated peptide variant
KWKLLKRLLKYFKPLKWAYAVRRQRNKYILMWMLARLKEHAAL

SEQ ID NO: 2461 - protein, 69 aa, Artificial Sequence
  Computer-generated peptide variant
RLKLLQKLFKFIKKKLKRHAKLLGKSRRSINATVALLLAWVNQIINKRNIKVLLVYICAKKAMQNKKVA

SEQ ID NO: 2462 - protein, 25 aa, Artificial Sequence
  Computer-generated peptide variant
RYRLMRRLLKRWQKLREPALCSTLH

SEQ ID NO: 2463 - protein, 30 aa, Artificial Sequence
  Computer-generated peptide variant
KIKFFRRLIKMLKRAAARPMRRALVCLASS

SEQ ID NO: 2464 - protein, 47 aa, Artificial Sequence
  Computer-generated peptide variant
KYKMMCRLLRLLKNTHARRHKRFLHAKAQLGTRLFKEWKEVKRNMDA

SEQ ID NO: 2465 - protein, 47 aa, Artificial Sequence
  Computer-generated peptide variant
KLKLYRKWLRFMKHIQRCNFKARAVFFNRSERAGAQKKLLLLVLEIR

SEQ ID NO: 2466 - protein, 40 aa, Artificial Sequence
  Computer-generated peptide variant
MLKLIKKWIKKLHPDTRFHAQRLKALAYALFRWAVKMRAR

SEQ ID NO: 2467 - protein, 40 aa, Artificial Sequence
  Computer-generated peptide variant
LFRILKKLIRKLQSKRTGHLKSKDQQVHALRPLACWLLRA

SEQ ID NO: 2468 - protein, 20 aa, Artificial Sequence
  Computer-generated peptide variant
ILRLWKRYFKWLKRLQQGWL

SEQ ID NO: 2469 - protein, 59 aa, Artificial Sequence
  Computer-generated peptide variant
FFRLFRKYYRKLHKCKNEWSKAAALMAWKKAPMPKAKQAADLRDAIGQLWNYILALARA

SEQ ID NO: 2470 - protein, 31 aa, Artificial Sequence
  Computer-generated peptide variant
RMRWFRKMFRRLHNAAMCAYARKAPNRRFAL

SEQ ID NO: 2471 - protein, 36 aa, Artificial Sequence
  Computer-generated peptide variant
KMRLIKKWLRRFRSQRCALLAAKKAFNKGNNAYSRE

SEQ ID NO: 2472 - protein, 40 aa, Artificial Sequence
  Computer-generated peptide variant
RFKMIRRWIKKFRKLIRLPAIRLRLWRQLLAHQRVHAHPA

SEQ ID NO: 2473 - protein, 65 aa, Artificial Sequence
  Computer-generated peptide variant
RWKILKRILRMFKKDPRAGAMKRALVRLLWRKHLADKPFIWLVLSRLVPAKALRAHRRWEGSMAW

SEQ ID NO: 2474 - protein, 27 aa, Artificial Sequence
  Computer-generated peptide variant
RLKLISKLLRKFQKFAWRCAKLPQAAQ

SEQ ID NO: 2475 - protein, 24 aa, Artificial Sequence
  Computer-generated peptide variant
RLKLWRKLLRRLHKAIMSSVRTLM

SEQ ID NO: 2476 - protein, 24 aa, Artificial Sequence
  Computer-generated peptide variant
KLRIMKKLMRLLCKYGVIAKSKLG

SEQ ID NO: 2477 - protein, 55 aa, Artificial Sequence
  Computer-generated peptide variant
RFRWLRRWFRLFRQALRRKRLPLLRHKFIRMALRNWAKAAIRDDAPPAKLTADRC

SEQ ID NO: 2478 - protein, 29 aa, Artificial Sequence
  Computer-generated peptide variant
LFRLLRRYWKWLCHHELAPFRLRKKARKI

SEQ ID NO: 2479 - protein, 43 aa, Artificial Sequence
  Computer-generated peptide variant
FLRMLKKFMRKWNRRPAHKYLLTCRPLLKKLFGAEKLKKFDMN

SEQ ID NO: 2480 - protein, 60 aa, Artificial Sequence
  Computer-generated peptide variant
RWRLLCKWYKFLNRYDNSALGLEAVLYLMAALRRPAVDYQLKCKMKLRFTRTKTLKKAKN

SEQ ID NO: 2481 - protein, 68 aa, Artificial Sequence
  Computer-generated peptide variant
KFRLMKRFLRKWQKRKKPINLAASRLKRKLAQNAMKERLAKAHTWLPLDHAKKFRAGMRSFYVACCSD

SEQ ID NO: 2482 - protein, 35 aa, Artificial Sequence
  Computer-generated peptide variant
LLKWYRRWYRKFPKYALGLQMRAAKRVLGAHNPRR

SEQ ID NO: 2483 - protein, 27 aa, Artificial Sequence
  Computer-generated peptide variant
ILKFLQRLFRMFTQKYPAKRKCDAARL

SEQ ID NO: 2484 - protein, 44 aa, Artificial Sequence
  Computer-generated peptide variant
FLKFLNRFFRKIKKLTRLRALCLDGRIKAKRLRAEHRWLYFRAG

SEQ ID NO: 2485 - protein, 56 aa, Artificial Sequence
  Computer-generated peptide variant
WYKWLSKLLRYLRRCFFIAEYKSRLHKRKRRGRYRKLECLKAGLLRHQKVQTAAAT

SEQ ID NO: 2486 - protein, 33 aa, Artificial Sequence
  Computer-generated peptide variant
MWRLYRRLLRFWKRDPLKSALLLAAARRLRDSC

SEQ ID NO: 2487 - protein, 75 aa, Artificial Sequence
  Computer-generated peptide variant
RYKIIRRYYRILRKCPAFKCLDHAQLRELMSKYVTFMKATAALLKAKDGARKRLFIALRLMRYIRALCARRAKPH

SEQ ID NO: 2488 - protein, 52 aa, Artificial Sequence
  Computer-generated peptide variant
WFKFLKRLIRRLRTRQHMNKFAAALRGANQNRALDDRLNMLAALYYRWKRHA

SEQ ID NO: 2489 - protein, 56 aa, Artificial Sequence
  Computer-generated peptide variant
LMRFFKKLLKRLKRMRYLCQQRGSRLRVPVLKKAQITAPARMLRCIARCEALRCCT

SEQ ID NO: 2490 - protein, 66 aa, Artificial Sequence
  Computer-generated peptide variant
IFKFLPRLIKRLSHIDLGRLRPLIFRHLTKLKLHRALRRQKLREELGVACKRPTLKYRHNLAEAQA

SEQ ID NO: 2491 - protein, 41 aa, Artificial Sequence
  Computer-generated peptide variant
FLRFFRRFLKWLNKKKIADLIKARAKLAASKRETAFWIKAE

SEQ ID NO: 2492 - protein, 31 aa, Artificial Sequence
  Computer-generated peptide variant
MIKILRRIFRKLRQKLSLEARLLQVRKSAIG

SEQ ID NO: 2493 - protein, 68 aa, Artificial Sequence
  Computer-generated peptide variant
KMRWICKLLRKYCRYKRKLTKLLDNRRPKNNRGALDLLQLNCFAKADDCLRLLKDALKNCPHKAAWHM

SEQ ID NO: 2494 - protein, 30 aa, Artificial Sequence
  Computer-generated peptide variant
MLRILRKLWKKLKRLLPQTCRCPGTKALHK

SEQ ID NO: 2495 - protein, 65 aa, Artificial Sequence
  Computer-generated peptide variant
RLRWLTRLMRRYNRSRLTKLSVAHRKPRARHKQRKDLLAGLAARAWKSFQKYYYYYTNRGAARNA

SEQ ID NO: 2496 - protein, 36 aa, Artificial Sequence
  Computer-generated peptide variant
KFKLLHRLLKKLRKRLLKLARFQVYYRNCYITPKAC

SEQ ID NO: 2497 - protein, 34 aa, Artificial Sequence
  Computer-generated peptide variant
RLKYFTKWLKKYTKERALAFAIALALRMAPWRKF

SEQ ID NO: 2498 - protein, 94 aa, Artificial Sequence
  Computer-generated peptide variant
LLRLIKKLMRKLCRAKERAARYDSAANAKLQPNRWRSKLARERDHSLHLHRSFVCKAMRIVGAKRKKKSLQFNWVRASDECWGRARRLWKKAVA

SEQ ID NO: 2499 - protein, 49 aa, Artificial Sequence
  Computer-generated peptide variant
RLRYFRRWLKLIKKQRRWLLASRAEHAALRKRIQKCKMRKAKLLSQALY

SEQ ID NO: 2500 - protein, 22 aa, Artificial Sequence
  Computer-generated peptide variant
KLRFIQKYLKFLKNGMKACALL

SEQ ID NO: 2501 - protein, 30 aa, Artificial Sequence
  Computer-generated peptide variant
KFKIFKRLWRFFRKLRLDPCEKYWADAALL

SEQ ID NO: 2502 - protein, 53 aa, Artificial Sequence
  Computer-generated peptide variant
LFRLWRRLFRRYNKAQTKKPKGPFKRFLRPALKLCLRHTKNSLQLASQLDADA

SEQ ID NO: 2503 - protein, 45 aa, Artificial Sequence
  Computer-generated peptide variant
RLRMLPRFIRKLRKWNLWTRHGTLRAHDKAIDLAANYGAYKTKLR

SEQ ID NO: 2504 - protein, 41 aa, Artificial Sequence
  Computer-generated peptide variant
LWRMMQRMFKRLNKLRLAIIKALDNDANATMPRLPRAVKKK

SEQ ID NO: 2505 - protein, 89 aa, Artificial Sequence
  Computer-generated peptide variant
RLRYFTRFIKKFKRCVGCWNPLYQLAAKMELARALLHKRLKKKAQAHTFKHLPIAQAVAIRADHERMAANAPKLMKRVRLVLATAKRRK

SEQ ID NO: 2506 - protein, 48 aa, Artificial Sequence
  Computer-generated peptide variant
RFRLLSRWLRYIRPKAAYAWVTRLAKFLKARKAQPCRKQPAMVSKEAL

SEQ ID NO: 2507 - protein, 64 aa, Artificial Sequence
  Computer-generated peptide variant
WLKLFKRFYRRFKKVKAAILLVLDRKRRLLLAKHLFLKLCKAHKKSRMFRQIHKALKARCNVAK

SEQ ID NO: 2508 - protein, 29 aa, Artificial Sequence
  Computer-generated peptide variant
KLKFLPRLLKIMNKNFKRALLQKQLLKAA

SEQ ID NO: 2509 - protein, 23 aa, Artificial Sequence
  Computer-generated peptide variant
RLRLLHRLMRKLKRWSAYNPDLA

SEQ ID NO: 2510 - protein, 32 aa, Artificial Sequence
  Computer-generated peptide variant
RLKLFKKILRRMTRDLHLMEAMKKRRKMLMAL

SEQ ID NO: 2511 - protein, 21 aa, Artificial Sequence
  Computer-generated peptide variant
RLRMLKKWLRILTKLQKKAIV

SEQ ID NO: 2512 - protein, 100 aa, Artificial Sequence
  Computer-generated peptide variant
MLKFIHRYIRWIPRHHQMRRVRADAALVKNPARAKQNARRLKRVLLKWSRRKHTHCKARHWYAARRAPKWRLAKTLAGLLPNRKFKNARNDLKDALDRML

SEQ ID NO: 2513 - protein, 32 aa, Artificial Sequence
  Computer-generated peptide variant
KLKWLNRFWRKYKNRLKKLTTQKLKWWLAEAY

SEQ ID NO: 2514 - protein, 29 aa, Artificial Sequence
  Computer-generated peptide variant
KFKLLPRLMRFWPKTYRKPDLRVALATLK

SEQ ID NO: 2515 - protein, 45 aa, Artificial Sequence
  Computer-generated peptide variant
LIKYFPRWFRKFCKQKRGARLLLKHWVLKRMKKHLLLPANAAQRK

SEQ ID NO: 2516 - protein, 49 aa, Artificial Sequence
  Computer-generated peptide variant
LFKWLKKWIRIWKKLAACASKRRLLAMFHKKRKCLRGTACKIKLKLFDD

SEQ ID NO: 2517 - protein, 66 aa, Artificial Sequence
  Computer-generated peptide variant
WMRFLKRLMKLIKRKRAKQCELEDILQKRKARNKHRSWCKKAFSAKLAPLHAAKRKNIALTTQKYI

SEQ ID NO: 2518 - protein, 70 aa, Artificial Sequence
  Computer-generated peptide variant
RFKFFKKLLRIFTQNRLKAKCAKLSLKARAALLMHPRKDKQHLALKLNPLSCADTLKTANWRRCCRKART

SEQ ID NO: 2519 - protein, 53 aa, Artificial Sequence
  Computer-generated peptide variant
RYRFLHKIFKWLRTAYNKLQRYQKCQAKAGKDQRAIAGRRARQRKARKTALWL

SEQ ID NO: 2520 - protein, 50 aa, Artificial Sequence
  Computer-generated peptide variant
KLKMFKRLLRRWPPKLAMRTLLERHAWKLNLFRRHLIAARRPKVSKHSNT

SEQ ID NO: 2521 - protein, 52 aa, Artificial Sequence
  Computer-generated peptide variant
KWRFLKKMMKRFKKDAQRFAAWTAAMGAALVYRLIALRWYTHRELVAGLKAA

SEQ ID NO: 2522 - protein, 29 aa, Artificial Sequence
  Computer-generated peptide variant
IWRFLRKLMKWLRNLKLSLNLKYRADKKL

SEQ ID NO: 2523 - protein, 39 aa, Artificial Sequence
  Computer-generated peptide variant
ILRYFHKLLKRLKNKAKRAYRLDMLANRTLNYCKMKCKV

SEQ ID NO: 2524 - protein, 20 aa, Artificial Sequence
  Computer-generated peptide variant
LLRLWKRLFRKIKCACAHKE

SEQ ID NO: 2525 - protein, 25 aa, Artificial Sequence
  Computer-generated peptide variant
LIKFWHRYLRRIPPKLSAKPRIARL

SEQ ID NO: 2526 - protein, 100 aa, Artificial Sequence
  Computer-generated peptide variant
KLKLMKKLFRKFRHSLARWAGAKTWLKYKRAWRMLLKKLMLRRPNWDRKPRVKRPFICLRNKWADKLRKPQHGPPLRQKLDPRLAFALLPHGYRWGACCS

SEQ ID NO: 2527 - protein, 63 aa, Artificial Sequence
  Computer-generated peptide variant
KMRYLTKYFRRFRRYGLILAARPAKLLLLLRADKLIYRLPSLNKKLNQKRKFIMLYRCNRGKA

SEQ ID NO: 2528 - protein, 95 aa, Artificial Sequence
  Computer-generated peptide variant
YLRLICKLWKKWKSYWGLPWAGPKLAYFASHDEARNKSLSAKVRFAVARRNHVEEAKLLLRYHNSADFAKLWKKSVLKALLDKARNARRAKLWAK

SEQ ID NO: 2529 - protein, 40 aa, Artificial Sequence
  Computer-generated peptide variant
FLKLWKKFIKLFKKRTCRGKRTLLSIDRFRANRNHLAENA

SEQ ID NO: 2530 - protein, 34 aa, Artificial Sequence
  Computer-generated peptide variant
LLKLMRRIIKKLRHKYRIKAKYAYLNFWKQLQCA

SEQ ID NO: 2531 - protein, 25 aa, Artificial Sequence
  Computer-generated peptide variant
LFKFLSRYMRKFKRVALARRQWHCA

SEQ ID NO: 2532 - protein, 25 aa, Artificial Sequence
  Computer-generated peptide variant
RLKFLQKFFRKLNQTKRAMMALRHC

SEQ ID NO: 2533 - protein, 86 aa, Artificial Sequence
  Computer-generated peptide variant
FMRLWRKLFKRFRPPRAIPRVAKKLGALRRKRVAHAMFEQQLAKRYLLRRLKWQFMYKAIVAREHAAKAMLQERTAWLSLQARTYK

SEQ ID NO: 2534 - protein, 36 aa, Artificial Sequence
  Computer-generated peptide variant
FMRFLRKFLKKFCSAADPPKRFVRVLASRAAKKIAW

SEQ ID NO: 2535 - protein, 21 aa, Artificial Sequence
  Computer-generated peptide variant
IYRLLRRLFKLIKNWKLARYL

SEQ ID NO: 2536 - protein, 44 aa, Artificial Sequence
  Computer-generated peptide variant
RMRIWRRLLRRLHKQMLPKVKRAAAYMHLHSRLLQADCRTFAWR

SEQ ID NO: 2537 - protein, 75 aa, Artificial Sequence
  Computer-generated peptide variant
RWKWFRKLMRKLRRLYWKCVARASAAAARLRRVGLFKVLLVAKKRLPKFGRSDLAWLKQKNLLLQQNLLRGSPAM

SEQ ID NO: 2538 - protein, 41 aa, Artificial Sequence
  Computer-generated peptide variant
FWKLLHKFLRWLRTDLGFKLNKKALRSLEKDRWRLNWRAKY

SEQ ID NO: 2539 - protein, 60 aa, Artificial Sequence
  Computer-generated peptide variant
RYKLMNRFLKKFSRGKYLRRVRTRKPGKHMAAMAAAWLRLKMHRNAAYKLFALPRADDKD

SEQ ID NO: 2540 - protein, 74 aa, Artificial Sequence
  Computer-generated peptide variant
KMRLFKRWFKLIRKSPFYKKEQFMLKKVKLLYRFMALRLKIKLLRRRMKLAEDEINRAAATPKRQATAKLERAQ

SEQ ID NO: 2541 - protein, 62 aa, Artificial Sequence
  Computer-generated peptide variant
RMKYLKKFFRLMRCASYHLRPYKCRAKRGIKQSRYAARYKFLAKRRLARILKGCPLLMIALD

SEQ ID NO: 2542 - protein, 53 aa, Artificial Sequence
  Computer-generated peptide variant
FLKWLTRLFKRYRREFLCFALLCNKLRYYKRAATAKCPKPKSAKYRECGKIAL

SEQ ID NO: 2543 - protein, 57 aa, Artificial Sequence
  Computer-generated peptide variant
KLKIYKRMLRKFKRLTGSRPHNALHGAAAYLKKKGSIENALRARLVRCPAWDRKDEK

SEQ ID NO: 2544 - protein, 44 aa, Artificial Sequence
  Computer-generated peptide variant
IFRILRKWLRRFKNREAAACSLRFSCELRKLELLAKKKRIMAIK

SEQ ID NO: 2545 - protein, 43 aa, Artificial Sequence
  Computer-generated peptide variant
FLKLFNKWYKLLSSRTAMRRLLLQMLAATALRRGQCTPKRADH

SEQ ID NO: 2546 - protein, 41 aa, Artificial Sequence
  Computer-generated peptide variant
KLRMLKRWLKRYSQMVYAYYMKCAIKASPLTRARKAKDAAA

SEQ ID NO: 2547 - protein, 85 aa, Artificial Sequence
  Computer-generated peptide variant
LIKMFKRLFRRLRKLDWAKNELLAIEPECNCPPLAHKLFLLGTRLHKAAKYVHKWACADVVPECRARNAAVRALKRHLLKKMKYL

SEQ ID NO: 2548 - protein, 52 aa, Artificial Sequence
  Computer-generated peptide variant
RYRLYKKILRRMKRRALKYNYRSKYWRAMRAACWLASGAVAMDYFARDKRLA

SEQ ID NO: 2549 - protein, 65 aa, Artificial Sequence
  Computer-generated peptide variant
ILRFWKRMMKMFKPWKAICFSLKIAMYRKCVAAYLRFLTRRRHKHFLIRLKAAMKKALKLKTTAA

SEQ ID NO: 2550 - protein, 28 aa, Artificial Sequence
  Computer-generated peptide variant
KLRLLCRILKLWRRLEVRREIQYAAIHY

SEQ ID NO: 2551 - protein, 28 aa, Artificial Sequence
  Computer-generated peptide variant
KYRFLTRFIRLWRKALLAEGKLHRREWW

SEQ ID NO: 2552 - protein, 44 aa, Artificial Sequence
  Computer-generated peptide variant
RYRFYKRLLRLIRPPAAYRLILVTLAKRAAAKSHAARRSDIQKM

SEQ ID NO: 2553 - protein, 20 aa, Artificial Sequence
  Computer-generated peptide variant
ILRLLNRYYRMLSRARAAGG

SEQ ID NO: 2554 - protein, 55 aa, Artificial Sequence
  Computer-generated peptide variant
RFKYFRRYLKWFRQLDRFVCMHVKRRKKRELKNRRLLLVYSIYALVLWFAARALL

SEQ ID NO: 2555 - protein, 32 aa, Artificial Sequence
  Computer-generated peptide variant
KLRLLTKLFKKMRRNLGGALMRKSRWSLNLEA

SEQ ID NO: 2556 - protein, 96 aa, Artificial Sequence
  Computer-generated peptide variant
LLRIWQKLLRKIRRKHQKLAHWLKRKKLKKGLTRQAVTLYCMKRKAAMLLLNWNPLKDTALLLKRLALRGLRQIRNSKPTWIRERGWRKPDRSWTC

SEQ ID NO: 2557 - protein, 20 aa, Artificial Sequence
  Computer-generated peptide variant
IFRLWKKLMKKLKSRPALMF

SEQ ID NO: 2558 - protein, 69 aa, Artificial Sequence
  Computer-generated peptide variant
KLKLFRKLIKKLRRNALARALKRQAHVKWMQWQILELAFKRSLCDKELQRLARLAAKIKAWLARNLRQD

SEQ ID NO: 2559 - protein, 31 aa, Artificial Sequence
  Computer-generated peptide variant
WWKLLRRLLRRLQRVRLRGLSKKKFEALNHT

SEQ ID NO: 2560 - protein, 31 aa, Artificial Sequence
  Computer-generated peptide variant
KYRMLKKWMRRLKRALITKPLAGKQAARFRA

SEQ ID NO: 2561 - protein, 39 aa, Artificial Sequence
  Computer-generated peptide variant
LLKLFCRWLKFYPNHRFGKHIVYFKLRAALRARRRPLYA

SEQ ID NO: 2562 - protein, 49 aa, Artificial Sequence
  Computer-generated peptide variant
RFRILKKFLKKMKKWWALAKLKKRNAPVANHHALAQFEKHMKFAYLGTG

SEQ ID NO: 2563 - protein, 46 aa, Artificial Sequence
  Computer-generated peptide variant
KWKMLKKWLRRYKSLEARRATDRMIIAMRAAALNAFKLNYKAAFRA

SEQ ID NO: 2564 - protein, 32 aa, Artificial Sequence
  Computer-generated peptide variant
RWRLLRKMWRKFQTMAERRLEGVKLAAAKVGR

SEQ ID NO: 2565 - protein, 33 aa, Artificial Sequence
  Computer-generated peptide variant
RMKLLKKLLKFMCRRLRALLMEGRRYESCKDLF

SEQ ID NO: 2566 - protein, 43 aa, Artificial Sequence
  Computer-generated peptide variant
KLRYLSRLLRLLRRRNLVEAFQHLRERGLAVWELRWVVKWRRG

SEQ ID NO: 2567 - protein, 96 aa, Artificial Sequence
  Computer-generated peptide variant
LYKLLKRLLRKLKRRLLLYRYMDSALFRHKRSLGIRLAAACRKMQNLRKWQKDKKKRGVNLAKRWPPASLATKSCAQLRAKLYPAGRRLQMSTMGK

SEQ ID NO: 2568 - protein, 69 aa, Artificial Sequence
  Computer-generated peptide variant
KFRMMRKFIRRFRPNAALKKRIAEIAVLKYARAEMLLAALESPAAKRLEARKYRLKKASLWKVLRKRNN

SEQ ID NO: 2569 - protein, 41 aa, Artificial Sequence
  Computer-generated peptide variant
RLRWITKLFRRLQCRLIARALTLPNADHLGKGKCVRRAPRA

SEQ ID NO: 2570 - protein, 72 aa, Artificial Sequence
  Computer-generated peptide variant
LIRMIKRMYKLYPPPVLKRWPRPANIKRLLCYLNHLRNKRRGSLRRGLKRASKATLHVVMANRLRALLLRYI

SEQ ID NO: 2571 - protein, 38 aa, Artificial Sequence
  Computer-generated peptide variant
LWKILKKILRKLRKLGSRKQLLHAPRAKHRLSVGAKKI

SEQ ID NO: 2572 - protein, 21 aa, Artificial Sequence
  Computer-generated peptide variant
YYKFYQKLLKRLRPFELRARA

SEQ ID NO: 2573 - protein, 28 aa, Artificial Sequence
  Computer-generated peptide variant
FLKFLRKIMRWLPHPRLRKARHLIAYKT

SEQ ID NO: 2574 - protein, 43 aa, Artificial Sequence
  Computer-generated peptide variant
RLRMLHKFYRKLHRLNKEMLRAHPEVLYTQALAKKEARQATKV

SEQ ID NO: 2575 - protein, 71 aa, Artificial Sequence
  Computer-generated peptide variant
FIKFLRRMFKWLRKRLKAPKQRRGHCPWRKMRDDMLPLIMRLELRKKHQAAARACDVLLAKKMGPAREWKA

SEQ ID NO: 2576 - protein, 34 aa, Artificial Sequence
  Computer-generated peptide variant
RMRFLHKFLKKIRKQGCLNWAAYMRAPRLMWKAL

SEQ ID NO: 2577 - protein, 60 aa, Artificial Sequence
  Computer-generated peptide variant
KLRYFPRFLRKWKSFLQLSIAGLFRNMKAFELRLKAPKRWASWKRGKPRLNLIDSRRKPL

SEQ ID NO: 2578 - protein, 51 aa, Artificial Sequence
  Computer-generated peptide variant
YMRLMSKIMRKYKRCLWWIRIRLWRKRADLDLRAAARLPGSCAKLKCKRRL

SEQ ID NO: 2579 - protein, 68 aa, Artificial Sequence
  Computer-generated peptide variant
WFRWLTRMFKMFQKLQSCAWDRLLLQRRKRGRKFKPMEALRKKPLGLLAARRKSKDATSLLSLKAIPL

SEQ ID NO: 2580 - protein, 34 aa, Artificial Sequence
  Computer-generated peptide variant
IWKWLCKLLKLFRKEKRRCRAAHMRMAYALCHWV

SEQ ID NO: 2581 - protein, 28 aa, Artificial Sequence
  Computer-generated peptide variant
RLKYFKKLLKRLCKPACEDPSAAAIAIC

SEQ ID NO: 2582 - protein, 27 aa, Artificial Sequence
  Computer-generated peptide variant
FFKWMRRWLRMLKSAALKLRDRMCRML

SEQ ID NO: 2583 - protein, 41 aa, Artificial Sequence
  Computer-generated peptide variant
MFRLFTKLIRMLKKLAQDNDRPLRRMKMALAVKWIRLGALR

SEQ ID NO: 2584 - protein, 83 aa, Artificial Sequence
  Computer-generated peptide variant
RLKFFPKYLKRYRNLKRATPKHRKIGLLPKVEISHARLLFLMRKFRLLLAARPIASNHNKREAVKNFPRLQLIKAGARAWMLV

SEQ ID NO: 2585 - protein, 21 aa, Artificial Sequence
  Computer-generated peptide variant
WYKLYSKFLKLLRKALFRAEL

SEQ ID NO: 2586 - protein, 30 aa, Artificial Sequence
  Computer-generated peptide variant
IFKLLNKWFKLLRRWDLKDPALRRPKVFKQ

SEQ ID NO: 2587 - protein, 42 aa, Artificial Sequence
  Computer-generated peptide variant
LYRFLRKFIRRMKKTAFLAMWMLLDRDARNRLIRLYGRKRWQ

SEQ ID NO: 2588 - protein, 25 aa, Artificial Sequence
  Computer-generated peptide variant
YLRWWRKLLKILRTLCAFIKRANKE

SEQ ID NO: 2589 - protein, 85 aa, Artificial Sequence
  Computer-generated peptide variant
LLRFYSKLFKKLRRMHIEHLREALTKCYTKRKLALKLKRCKAKFYYRASSYESAVAKAKSEKKAMPPGARKMGKKYWRDIRKANA

SEQ ID NO: 2590 - protein, 39 aa, Artificial Sequence
  Computer-generated peptide variant
FLKLLCRWFRRLRKDAGMLAGRAIWQKARIAKQVLSNAV

SEQ ID NO: 2591 - protein, 20 aa, Artificial Sequence
  Computer-generated peptide variant
LFKLLNKLIRKFRRHLRTNL

SEQ ID NO: 2592 - protein, 77 aa, Artificial Sequence
  Computer-generated peptide variant
KWRLYSKIMKRLKPLRSRYHKPLWLKRAQAASCNASAGLAYGAACPSREPKAIEKRALALGRVRLSDKHRADLAVKP

SEQ ID NO: 2593 - protein, 23 aa, Artificial Sequence
  Computer-generated peptide variant
RMRLIRRLMRRWKHFSKAGAALI

SEQ ID NO: 2594 - protein, 26 aa, Artificial Sequence
  Computer-generated peptide variant
YLKMFHRFLRRMKKDSRSLFLLLRAM

SEQ ID NO: 2595 - protein, 30 aa, Artificial Sequence
  Computer-generated peptide variant
LFRMLKRIWRRIRTAFAHVKRHARAGLAWS

SEQ ID NO: 2596 - protein, 30 aa, Artificial Sequence
  Computer-generated peptide variant
KLRWFKRWYKILKRLAAAPKSARLLRDGCG

SEQ ID NO: 2597 - protein, 54 aa, Artificial Sequence
  Computer-generated peptide variant
RYRLINRFFRLMKRARQLLMKRRAVPLAMLIRELCHLVNLKRTTAAQKDDLSSA

SEQ ID NO: 2598 - protein, 70 aa, Artificial Sequence
  Computer-generated peptide variant
YIRLLRRLLKFLRKELAAFNYAHIRAALMGNNRWAALAGIYVATPLLRYACHRKLPCKWKRKAHVRPKIQ

SEQ ID NO: 2599 - protein, 34 aa, Artificial Sequence
  Computer-generated peptide variant
RFRLLKKFMRILRRFPGRRRPLAASPKLLVIKLT

SEQ ID NO: 2600 - protein, 20 aa, Artificial Sequence
  Computer-generated peptide variant
KMRWFTRLIKFLKKMLQLSA

SEQ ID NO: 2601 - protein, 21 aa, Artificial Sequence
  Computer-generated peptide variant
RFRWLRKLLKFLRCEMATLHL

SEQ ID NO: 2602 - protein, 48 aa, Artificial Sequence
  Computer-generated peptide variant
RIRFLKRFLKRFRRLALSFPLAWWECAKYARERLNALAFLKYLWGGAR

SEQ ID NO: 2603 - protein, 47 aa, Artificial Sequence
  Computer-generated peptide variant
LLRIIRKLYKRFKRTRDASCFFCWAQYSRLDAKGKAAAQLKKMTGRA

SEQ ID NO: 2604 - protein, 48 aa, Artificial Sequence
  Computer-generated peptide variant
LFRIMSKLLRRWTRALEAEVHHKKAWARLRVALKLLLKKVRRQRSQCT

SEQ ID NO: 2605 - protein, 30 aa, Artificial Sequence
  Computer-generated peptide variant
FLKFMKRLLRKFKRVATKLWGKNAKLNAVH

SEQ ID NO: 2606 - protein, 52 aa, Artificial Sequence
  Computer-generated peptide variant
RYRLYHRLFRIFTRVRYRKMKRDCLSLNRRCALARRAYMKLAQFTALRCPEL

SEQ ID NO: 2607 - protein, 30 aa, Artificial Sequence
  Computer-generated peptide variant
LLRMMRKFIRMITRFFAKAARLYAIKLDAK

SEQ ID NO: 2608 - protein, 36 aa, Artificial Sequence
  Computer-generated peptide variant
RIRLLCRIWRFITNLDLASRLRFKASNKNGRKADLA

SEQ ID NO: 2609 - protein, 27 aa, Artificial Sequence
  Computer-generated peptide variant
KLKLFRRYLRLLTNVYKQYQNLAFCRL

SEQ ID NO: 2610 - protein, 39 aa, Artificial Sequence
  Computer-generated peptide variant
LLKLLSRIMKRYPKEKRLRRKLLLKKACHPFNLSGFARI

SEQ ID NO: 2611 - protein, 69 aa, Artificial Sequence
  Computer-generated peptide variant
YFKLFKKLLKRYKHYLRTTAWRLQYKKRLAWRQDLLSLHSYNQLPLIRYRKFANSLCWKILRDALVLKK

SEQ ID NO: 2612 - protein, 45 aa, Artificial Sequence
  Computer-generated peptide variant
RFRFLKRMYKKLPKVAHMLNMEQLLPAPKRRMDRRSVNLNLARLR

SEQ ID NO: 2613 - protein, 21 aa, Artificial Sequence
  Computer-generated peptide variant
FLRLWSRLFRRFSRRLTWALE

SEQ ID NO: 2614 - protein, 91 aa, Artificial Sequence
  Computer-generated peptide variant
KYRLYRRLLKLWRRAAGKRYTRCRTACGWHNARAAIPLLREVVDWAAAKKKWAKVRKKGAYYRKPNHKMKLADKYANQPHFRLSKRYAKRK

SEQ ID NO: 2615 - protein, 49 aa, Artificial Sequence
  Computer-generated peptide variant
RLKWISRYIKKIKRRFKRKFAAQIHWRMNAKLAWPVKALLDAEAAHIKL

SEQ ID NO: 2616 - protein, 56 aa, Artificial Sequence
  Computer-generated peptide variant
LLKLIRKLFKRYNREMLAWPACSAAYRKLLLFIKVRLASETKLLIDTICKLLIIKG

SEQ ID NO: 2617 - protein, 44 aa, Artificial Sequence
  Computer-generated peptide variant
KMKFLRKLIKLFHRLLRKALRSRTYAVMRMCLYKAANRHLVLLR

SEQ ID NO: 2618 - protein, 32 aa, Artificial Sequence
  Computer-generated peptide variant
IFKFLKKYLRRMKKCRMFLLKLCLRKCLLSPV

SEQ ID NO: 2619 - protein, 98 aa, Artificial Sequence
  Computer-generated peptide variant
KFRFLRRWLKKYHPRAVGRARKIHSAGMCIKFRYKKKAAKAIEGEARKYLSRVCRAGARAKCKLELILHLAKKQQLYALALARDDMRSKTTFETVTKK

SEQ ID NO: 2620 - protein, 90 aa, Artificial Sequence
  Computer-generated peptide variant
RYKLLRRLFKLFRSKRRLKALYNKEDRSKQRLSSAVNAMLHWNNTSCRRCLAWLKRLHKGRARLSRRRLRELRALSAASLNGHRSRQQEN

SEQ ID NO: 2621 - protein, 24 aa, Artificial Sequence
  Computer-generated peptide variant
FLKFFRRFLRRFKTAKRQLAHPIA

SEQ ID NO: 2622 - protein, 58 aa, Artificial Sequence
  Computer-generated peptide variant
RLRLLRKYMRRFQRKPGGAFTLAKAWHNTKLIEVLRNLRLLKKEKAALQTGDRTLLEA

SEQ ID NO: 2623 - protein, 85 aa, Artificial Sequence
  Computer-generated peptide variant
RIRLYTKLMRRLKTPAPEKCRAKSRLRLPDSLKLRTKGRRVQTAAVWKLATIRRNAAAAVNKYMQLLRDQAAKMKFARVYRKTAI

SEQ ID NO: 2624 - protein, 54 aa, Artificial Sequence
  Computer-generated peptide variant
FIRLFPKLLKYWSKELIRMAIQKGAAALSLLARQAKVGGMRQKCLRYKNLKDRA

SEQ ID NO: 2625 - protein, 29 aa, Artificial Sequence
  Computer-generated peptide variant
RWKFWPRWLKMMRRLAWGKALICLKAHKE

SEQ ID NO: 2626 - protein, 71 aa, Artificial Sequence
  Computer-generated peptide variant
FFRFLTRMFKLLKRAYHKIRPRCNNDTAKQWQRARLAKRAGARSWRKKRYKIILLYARNLLRADGDAARRE

SEQ ID NO: 2627 - protein, 22 aa, Artificial Sequence
  Computer-generated peptide variant
LWKLFTKILKRMRKWPLNAKKA

SEQ ID NO: 2628 - protein, 75 aa, Artificial Sequence
  Computer-generated peptide variant
LFRYIKKFIKKMKRLARWLRARQWQMAALNKAAKATGKALALQAKYLRHAKRILDLMDDKLQASEFKAEDSRFHG

SEQ ID NO: 2629 - protein, 48 aa, Artificial Sequence
  Computer-generated peptide variant
LFKLLRKYMRKLSQGLLMAKFEKKHQKANRAAHGARSKKKAKKRALEP

SEQ ID NO: 2630 - protein, 64 aa, Artificial Sequence
  Computer-generated peptide variant
ILKIWRKLYKILSKRSQKMRRGDLGYAWRAAPRLILGQKDRAGSLALPKPCKRLQNLANLCAAL

SEQ ID NO: 2631 - protein, 43 aa, Artificial Sequence
  Computer-generated peptide variant
LWRFLRRLLKKYKRTRYPWWAAKCLQRQARMHVNAAQFKMALC

SEQ ID NO: 2632 - protein, 21 aa, Artificial Sequence
  Computer-generated peptide variant
RIRLYKKLIRRLRHTAYWAEI

SEQ ID NO: 2633 - protein, 79 aa, Artificial Sequence
  Computer-generated peptide variant
LLRYIQRLMKRFKRFGVFRHGFAAFWCLALLNAVLQINKKPELHRWKSRKADLKEAARKNKRLKKAADVRLRVARRKAR

SEQ ID NO: 2634 - protein, 45 aa, Artificial Sequence
  Computer-generated peptide variant
RYKLLKRFLRMIKRALAALKLWMLKRLELGYASHRRDRSKLKYFP

SEQ ID NO: 2635 - protein, 88 aa, Artificial Sequence
  Computer-generated peptide variant
KIKIWKRLFRRYQKKFRTKLLCAMAILAKMMNKIRKFNMMLMHRAWLMMRPRTAKAKPATLAQFLKQQQVALRLHANAFALKHLPKLR

SEQ ID NO: 2636 - protein, 53 aa, Artificial Sequence
  Computer-generated peptide variant
LLKLYRRMLKFIRRPNVKARRHAAHSLSKRHAFRKKCRGCWRAARSALAQELG

SEQ ID NO: 2637 - protein, 39 aa, Artificial Sequence
  Computer-generated peptide variant
RLKFLQKWMKFYKQELQMLFPMLARQLNEKALKAARFAR

SEQ ID NO: 2638 - protein, 36 aa, Artificial Sequence
  Computer-generated peptide variant
LMRFLRKLFKKLKCADGHYLVACTMLRRLMKEALAK

SEQ ID NO: 2639 - protein, 20 aa, Artificial Sequence
  Computer-generated peptide variant
RWRLFKKMLKMLCNALNWLH

SEQ ID NO: 2640 - protein, 52 aa, Artificial Sequence
  Computer-generated peptide variant
LLRLFCKFLKKMRKRLLLHAVFVRKELETDRSTRWRKKELYAPHAKKAWRLM

SEQ ID NO: 2641 - protein, 73 aa, Artificial Sequence
  Computer-generated peptide variant
FLKLLHRFYKMLRKFHALWVIALLNADKPCKLLLAKRRNTKKRDLYHRSKLNKCLPRREGQLKIDDRRKMRAA

SEQ ID NO: 2642 - protein, 40 aa, Artificial Sequence
  Computer-generated peptide variant
FLKLISKYIRRLRCYPCIRPGKDLKALLKLRKDLLAAMWL

SEQ ID NO: 2643 - protein, 29 aa, Artificial Sequence
  Computer-generated peptide variant
FFRFYSKWLKIFHRLKLGRAELLAVKTKR

SEQ ID NO: 2644 - protein, 29 aa, Artificial Sequence
  Computer-generated peptide variant
RMRFLSKFLRYFKNRAFAAVDILALARGK

SEQ ID NO: 2645 - protein, 20 aa, Artificial Sequence
  Computer-generated peptide variant
FYRLLKRILKLYPRIGRAEA

SEQ ID NO: 2646 - protein, 42 aa, Artificial Sequence
  Computer-generated peptide variant
YLRLFNKMLKIFNKTASPAKAHLLEARKAKLSLKLIDMYRLD

SEQ ID NO: 2647 - protein, 28 aa, Artificial Sequence
  Computer-generated peptide variant
RMRIFRRLLKKIKHGAQRFKGFALAGAY

SEQ ID NO: 2648 - protein, 49 aa, Artificial Sequence
  Computer-generated peptide variant
FFKLLSKWIRFFNRLGLREKRGDLLQRKLALIAKNFDRSVLAYLPLKLQ

SEQ ID NO: 2649 - protein, 20 aa, Artificial Sequence
  Computer-generated peptide variant
WLKLYKRMLKWMHKLSGWKL

SEQ ID NO: 2650 - protein, 60 aa, Artificial Sequence
  Computer-generated peptide variant
FYKILKKMWRKLNRYKLKAIETRIRVKFGNDRYFDKLLRLAMVKAMRARKKMLWLLITAW

SEQ ID NO: 2651 - protein, 43 aa, Artificial Sequence
  Computer-generated peptide variant
FWKFMKRLWKLYRSRSRACVELKKLGLKVYKRRAHFMLWALLY

SEQ ID NO: 2652 - protein, 25 aa, Artificial Sequence
  Computer-generated peptide variant
RYRLLRRFLRFMRHWGFAYAAKVKY

SEQ ID NO: 2653 - protein, 25 aa, Artificial Sequence
  Computer-generated peptide variant
KLKFYQKWLKLMRRRYAANKAQIML

SEQ ID NO: 2654 - protein, 44 aa, Artificial Sequence
  Computer-generated peptide variant
RIRIFRKYLKRWKQRMALLAIRLYLAYERALGSLARKWFRVALT

SEQ ID NO: 2655 - protein, 32 aa, Artificial Sequence
  Computer-generated peptide variant
LLKFMCRIYKWYCKCAARSLAKKEKAGVPKLK

SEQ ID NO: 2656 - protein, 96 aa, Artificial Sequence
  Computer-generated peptide variant
RLKYMKKMMKWFRKKRKLLHLRRLTKYKTAAQKAAAKLKYSKQKYQRRAPRHLNGAAMCDPAAFDLAHKRIQRLAEMLGKAWRIRACRLQCRLKYC

SEQ ID NO: 2657 - protein, 31 aa, Artificial Sequence
  Computer-generated peptide variant
RYKFLKKLYKRFHNVLRAFPRIKLALRNANK

SEQ ID NO: 2658 - protein, 41 aa, Artificial Sequence
  Computer-generated peptide variant
YIKFLCKMFKRICRARRAARKLKCLAHAWALCPYPKVTPRR

SEQ ID NO: 2659 - protein, 33 aa, Artificial Sequence
  Computer-generated peptide variant
RLRWLHRFLKFIQKISQEKDRKLAPRRLAGLQA

SEQ ID NO: 2660 - protein, 98 aa, Artificial Sequence
  Computer-generated peptide variant
FFKLMSRLMRKYSQYGAWKKAWHRLAEQNMHYTLFWKYKLVLKKFALRRRKRLKPKKRTLTARLLGLRKRKAEFLARKIARLLAKEAAFIRICRKLLN

SEQ ID NO: 2661 - protein, 53 aa, Artificial Sequence
  Computer-generated peptide variant
RLKWLTRWFRMYKRKALKTKLHLKLALEKTSPMLAALSYAYLGGHHHKKAAKL

SEQ ID NO: 2662 - protein, 20 aa, Artificial Sequence
  Computer-generated peptide variant
WFRLLKRLWKLFPKCAQMKM

SEQ ID NO: 2663 - protein, 47 aa, Artificial Sequence
  Computer-generated peptide variant
KLRFLKRLIKWMRQPSRVLILASYMVQGLLKSAKKSWAGRKKLFKSK

SEQ ID NO: 2664 - protein, 79 aa, Artificial Sequence
  Computer-generated peptide variant
RLRMMKKLWKKFKRRLIKRWAIALRTFYLARWFQASACALCKLSLKPDAGTFPKWNLLLLYKLMLKTRWHKMLRKNFEN

SEQ ID NO: 2665 - protein, 27 aa, Artificial Sequence
  Computer-generated peptide variant
KLKIMCKILRRIRQRARVPLLRYNLHA

SEQ ID NO: 2666 - protein, 29 aa, Artificial Sequence
  Computer-generated peptide variant
RLKLIKRFWRKLKNLRQRQASHLPYFGHA

SEQ ID NO: 2667 - protein, 50 aa, Artificial Sequence
  Computer-generated peptide variant
RLRLLSRFMRKWPKKAGDMDRAALLEGLWLGANMLIAPHLAIVWKGKLRR

SEQ ID NO: 2668 - protein, 28 aa, Artificial Sequence
  Computer-generated peptide variant
KYKFLKRLLRLYKHATHPMKSQDLLWKR

SEQ ID NO: 2669 - protein, 48 aa, Artificial Sequence
  Computer-generated peptide variant
RYKLWKRLIRKFKKKRCYMLLNAAADWPEGGKKKLLLACCPLFRAFKA

SEQ ID NO: 2670 - protein, 45 aa, Artificial Sequence
  Computer-generated peptide variant
RIRLFRKWLKLIHKQAPSIAAYKKRRLGFDKAPAAAIALGRARAR

SEQ ID NO: 2671 - protein, 25 aa, Artificial Sequence
  Computer-generated peptide variant
MLRWLSKLLRLLRRIHVCNRLATRR

SEQ ID NO: 2672 - protein, 47 aa, Artificial Sequence
  Computer-generated peptide variant
KLRYYRRLLRFFKKYFECLEKDTLARLRMRDLLVRNKRFAIAAYQTL

SEQ ID NO: 2673 - protein, 32 aa, Artificial Sequence
  Computer-generated peptide variant
RIRLFRRILKFLRTAALYNRKAWKCMPALALS

SEQ ID NO: 2674 - protein, 33 aa, Artificial Sequence
  Computer-generated peptide variant
YWKLLSRLLKRFRKLNCMKRRPSAGRRDFLPFL

SEQ ID NO: 2675 - protein, 50 aa, Artificial Sequence
  Computer-generated peptide variant
WMRFFKKFFKLLKPKRTWQLLRALHRAIMAALRMLKLGLAYNKPEKHKKS

SEQ ID NO: 2676 - protein, 62 aa, Artificial Sequence
  Computer-generated peptide variant
LFKMMNRWYRLLKRRARLLRPLKDGKERSRQTKPKCLCKARALHPPSASDTDLRRLLLARQA

SEQ ID NO: 2677 - protein, 86 aa, Artificial Sequence
  Computer-generated peptide variant
RIRFLPRWMKKIKKKLARATEKAAIHWKRTASAKVFLRLLRHCKRYNAKKPKQLAKALLVYYKSGAKIRTVAAKKPKTVIFKSAPI

SEQ ID NO: 2678 - protein, 46 aa, Artificial Sequence
  Computer-generated peptide variant
LLRLFKRMFRKIRHKLLRHLLSKPMLYRADYAPPHRTNDIIAAKKA

SEQ ID NO: 2679 - protein, 30 aa, Artificial Sequence
  Computer-generated peptide variant
KMRFWKKLLRLLTTPESRSVLRMRLPLRLL

SEQ ID NO: 2680 - protein, 31 aa, Artificial Sequence
  Computer-generated peptide variant
LIKMLRKLFRRLKKAKKQKWPLLLKACWLKD

SEQ ID NO: 2681 - protein, 37 aa, Artificial Sequence
  Computer-generated peptide variant
KLRLLTKWWRRFRRENTLALHDGAKLYHRDLGAAMKV

SEQ ID NO: 2682 - protein, 36 aa, Artificial Sequence
  Computer-generated peptide variant
YLKLLRRMYKRMKRLRQARWCRGFMQNGALLPASAA

SEQ ID NO: 2683 - protein, 60 aa, Artificial Sequence
  Computer-generated peptide variant
RLRWLPKMLRKFKKLDLDKTKHRAAHTPNTKTSLGLWMTRKGASGLNVAKRLLDAHSRKR

SEQ ID NO: 2684 - protein, 41 aa, Artificial Sequence
  Computer-generated peptide variant
KWKYLCRLLKKFRKQHKLLRLQLANQNLDAMFNCGRRLKLI

SEQ ID NO: 2685 - protein, 43 aa, Artificial Sequence
  Computer-generated peptide variant
MWKILKRIFKRMKRRHGRALCLCKLLLNSLLKSWINRKPDLCL

SEQ ID NO: 2686 - protein, 53 aa, Artificial Sequence
  Computer-generated peptide variant
RWKFLKRWWRMLKKLHLQSAASGYTFAAARLARLACWANYSLAKNDLKLCRSR

SEQ ID NO: 2687 - protein, 22 aa, Artificial Sequence
  Computer-generated peptide variant
RLKLYKKWYRKIRNAHGLHAIL

SEQ ID NO: 2688 - protein, 64 aa, Artificial Sequence
  Computer-generated peptide variant
WFKYFRKLFKKLPRRRARAKPKRKAGAVRKDLVYASKIRNDLRRRLWYCLMAAWVTLRAEYLTR

SEQ ID NO: 2689 - protein, 23 aa, Artificial Sequence
  Computer-generated peptide variant
KLKLMRKLLRFMRRFPHYLSPLK

SEQ ID NO: 2690 - protein, 46 aa, Artificial Sequence
  Computer-generated peptide variant
WFRLLKRLFRKLCSPPIRRWFAFPCHRARKWRLWGLRRIKAKDQAA

SEQ ID NO: 2691 - protein, 24 aa, Artificial Sequence
  Computer-generated peptide variant
RLRFLSKLFRWLRRLRKDPLRVDL

SEQ ID NO: 2692 - protein, 43 aa, Artificial Sequence
  Computer-generated peptide variant
MFKFLNKLLRKFRRQHKRCLSALMTAKLFQALLCASGVKRASE

SEQ ID NO: 2693 - protein, 69 aa, Artificial Sequence
  Computer-generated peptide variant
FFKMWKRLWKKLKTRQAALATRSHNTRSRDWRLRKKDKLARAFAWTHSGKLNADVALAAALGTSLYWSR

SEQ ID NO: 2694 - protein, 30 aa, Artificial Sequence
  Computer-generated peptide variant
WIRILQRLIKMYRHKKKYLFLALRTSALKL

SEQ ID NO: 2695 - protein, 31 aa, Artificial Sequence
  Computer-generated peptide variant
KLRIIRRLFKWLTKFLAMKWTKLAQKLYMLA

SEQ ID NO: 2696 - protein, 38 aa, Artificial Sequence
  Computer-generated peptide variant
RLKLLRRFWRKIKTFLVEAQEKIPANAARCLAKKGHNE

SEQ ID NO: 2697 - protein, 25 aa, Artificial Sequence
  Computer-generated peptide variant
KFKLFKKLLKKMKTLDLARKATINH

SEQ ID NO: 2698 - protein, 30 aa, Artificial Sequence
  Computer-generated peptide variant
RLKYFKKFLRMWKSILKAKNIAKQAAAEVN

SEQ ID NO: 2699 - protein, 48 aa, Artificial Sequence
  Computer-generated peptide variant
RLKFIRKILKILRKRLLQCLGKLKQAGRIALCKKVAEVLRNGAACLAL

SEQ ID NO: 2700 - protein, 73 aa, Artificial Sequence
  Computer-generated peptide variant
ILKMYSKILRFLRCQTARFQHRAKKYRRARLLKGIAKLLRPHWRSHKQCRLASAANLMIKLLNLAGAMASNMA

SEQ ID NO: 2701 - protein, 66 aa, Artificial Sequence
  Computer-generated peptide variant
LIKLMRKYLKKMKRMDILVARYGFRARACAFRKLRRDRRLKSGWAWKRKIAWAWYHHILAAARNCV

SEQ ID NO: 2702 - protein, 90 aa, Artificial Sequence
  Computer-generated peptide variant
FLKLYRRLFKRLKKRPLLKAKRDKKKLKVRNMKPAALALLCRLMRAHMIWPTKKANFMRDRVMVKLNIWVLRALYKHQKIRARHHPRGIK

SEQ ID NO: 2703 - protein, 39 aa, Artificial Sequence
  Computer-generated peptide variant
RYKFYRRILKLFKKEPARQLLWLKLALLANRHLNDNRDY

SEQ ID NO: 2704 - protein, 24 aa, Artificial Sequence
  Computer-generated peptide variant
LMKFMRKLFKRLKSQASAKTQILA

SEQ ID NO: 2705 - protein, 43 aa, Artificial Sequence
  Computer-generated peptide variant
LLKYWKRLFRRLKKPYRDASLMRIALAFDLCAQGRALRECDAP

SEQ ID NO: 2706 - protein, 49 aa, Artificial Sequence
  Computer-generated peptide variant
WMRFMRKFFRMIPRSTKPPRLANKLLRKARAWRTALKNAAQKKKATQAA

SEQ ID NO: 2707 - protein, 67 aa, Artificial Sequence
  Computer-generated peptide variant
FIKLFKKYFRMLHRELAAGAGKRKERRVVATRGDLRKLARNKRLYAIKYARDCDRSLHLRWAYSGRE

SEQ ID NO: 2708 - protein, 79 aa, Artificial Sequence
  Computer-generated peptide variant
KFKILKKLMRLLRQFWRCFIKYHLLKLKPVVVAAKLKLRRKKKAMARKLGKSCGKMLGDNNHQKLAKTMRLSPRALFLA

SEQ ID NO: 2709 - protein, 28 aa, Artificial Sequence
  Computer-generated peptide variant
RFRMYRKLLKLWKCYAHRCLEARLNLRT

SEQ ID NO: 2710 - protein, 29 aa, Artificial Sequence
  Computer-generated peptide variant
KWRMMRKLYKKFKCVARLTKYKAALAAQE

SEQ ID NO: 2711 - protein, 77 aa, Artificial Sequence
  Computer-generated peptide variant
FLRFLKRWWRRLHKYLYVHRYVGVGLPLLAFYQTAAMMKLKLHGIKPLALMKRRKAVAAAILKETPLYKKNLKSALR

SEQ ID NO: 2712 - protein, 38 aa, Artificial Sequence
  Computer-generated peptide variant
LMRLIQKLIRWLRRLCCRLRDKVKAAAPARSAGERDAV

SEQ ID NO: 2713 - protein, 29 aa, Artificial Sequence
  Computer-generated peptide variant
LFKILKKFLRKLRKRHWLCAALADHFMEK

SEQ ID NO: 2714 - protein, 37 aa, Artificial Sequence
  Computer-generated peptide variant
RFKWFHKILRLYKRAAKRAFLDKRLHLHPVLLKWKKN

SEQ ID NO: 2715 - protein, 50 aa, Artificial Sequence
  Computer-generated peptide variant
LFKILKRLWRKIKRCYKCARMMPQRMAARKAKPKACSEKAFDARALENST

SEQ ID NO: 2716 - protein, 50 aa, Artificial Sequence
  Computer-generated peptide variant
MFKFIRRLLKWWSHLDGDLVACRALAPKIVRLNKKAHYRRAIAKDKRLMR

SEQ ID NO: 2717 - protein, 62 aa, Artificial Sequence
  Computer-generated peptide variant
KWKYMNRFFKLIRCVRLLLLKPRKARYKWIIQRALRLRAKYVATKALKIKKRAAWESLKWML

SEQ ID NO: 2718 - protein, 20 aa, Artificial Sequence
  Computer-generated peptide variant
FMKFLSKLLRKINRLLKKCA

SEQ ID NO: 2719 - protein, 29 aa, Artificial Sequence
  Computer-generated peptide variant
KFRLIHRFLRLYKKHAHYLRATGLWAYRA

SEQ ID NO: 2720 - protein, 34 aa, Artificial Sequence
  Computer-generated peptide variant
MLKYWHKYLRLFQKRFPAARLNRRKSHSKKNALA

SEQ ID NO: 2721 - protein, 73 aa, Artificial Sequence
  Computer-generated peptide variant
RLRYMKKILKILRCATNVHGRRKFEKLWAWLRKAYIAGADAKLKYLAGRCAKERKMAKQLAYVAYLSEAHRDI

SEQ ID NO: 2722 - protein, 29 aa, Artificial Sequence
  Computer-generated peptide variant
KLKLWNRYWRRIRKLMFWRRCAHALAWLT

SEQ ID NO: 2723 - protein, 48 aa, Artificial Sequence
  Computer-generated peptide variant
KFRFWNRMLKLFRPNLRLMLISYIGWRLLPRGRWLALAKDKAALKAER

SEQ ID NO: 2724 - protein, 83 aa, Artificial Sequence
  Computer-generated peptide variant
RLKMLHKLWKKWCHLLKGAPQYRLPPKIVAEAKMNSACRLCRDDRSAAKGRGKKYIDKKCKKRLSKSRLRKLKQSLDKNMLLF

SEQ ID NO: 2725 - protein, 67 aa, Artificial Sequence
  Computer-generated peptide variant
YLRLYCKLLRKFRREACWFRRMYSMSALCRMYWRDAKKGANKIKIRALTRANLRAALRALMIAACCQ

SEQ ID NO: 2726 - protein, 98 aa, Artificial Sequence
  Computer-generated peptide variant
FYKFYKRIFRKIRKTHKKANHLLPATSLANGMRDKDQWLMALGHVKKKLRLTRLSVAHVVRIADRSEAKHLKAARKKESNARRKAKLTLGRLKLAVSE

SEQ ID NO: 2727 - protein, 77 aa, Artificial Sequence
  Computer-generated peptide variant
LIKYLKKLWKILKKLKLLWQRTTFLCMSKSHQEAARLDRRGGWAAARLPHRVHGDKVDKRKCLANANKKQKAVRADL

SEQ ID NO: 2728 - protein, 92 aa, Artificial Sequence
  Computer-generated peptide variant
FWKMLKRFLRKIKRWAHLLYRRMGRAKYKANAHRLWLLDQHRQLNKLRDRADLKLKMEWYTRPARRILAKHACWRKSLLRKCNVRDEAGLQC

SEQ ID NO: 2729 - protein, 52 aa, Artificial Sequence
  Computer-generated peptide variant
KFKLLCKYIKLMPRKRAMWALQGRRWRLKLFAWEYKAAKSEKAWVERRMRLC

SEQ ID NO: 2730 - protein, 38 aa, Artificial Sequence
  Computer-generated peptide variant
KLKILCKLIRLLKKPKSNCANKIILWNRAAALMVEKDK

SEQ ID NO: 2731 - protein, 57 aa, Artificial Sequence
  Computer-generated peptide variant
RLRFFSKLLKRWRHAKCKKFEPNAMGQKLKHYLRLHWKLMKVRQLPLALNLKRLMAY

SEQ ID NO: 2732 - protein, 33 aa, Artificial Sequence
  Computer-generated peptide variant
KLKMLKRFLKKLSRKAPFALHNARLKHQLLADK

SEQ ID NO: 2733 - protein, 53 aa, Artificial Sequence
  Computer-generated peptide variant
RWRILRRLLKWFKNRALERLMVCLTYVRQASRGLMKKRLKLLKDLRLLERFTN

SEQ ID NO: 2734 - protein, 41 aa, Artificial Sequence
  Computer-generated peptide variant
RYRMLRKLLKKWRHATHHKRVWDLKRWRRACLLPATWGALH

SEQ ID NO: 2735 - protein, 78 aa, Artificial Sequence
  Computer-generated peptide variant
KLKLIKRFLKRFKKARTDHAFVARRMKNPPKMHPLQTRNPIAYALRRKALFPLRARRILASRTHACAKAEEVMLRGIL

SEQ ID NO: 2736 - protein, 32 aa, Artificial Sequence
  Computer-generated peptide variant
KIKLIKKLFRRWRPLRLITKETAAMARAWLYL

SEQ ID NO: 2737 - protein, 48 aa, Artificial Sequence
  Computer-generated peptide variant
LLRFYKKMLRLYNKCWVRLRLCPCKAQSLNCPLKAAKGLWHFLARKKR

SEQ ID NO: 2738 - protein, 65 aa, Artificial Sequence
  Computer-generated peptide variant
RLRYYTRFLKRFKHREALKFCNKCTKYRQYVLLKIKLAAMLRALATCAKDKSLSRAKVFFAKCRI

SEQ ID NO: 2739 - protein, 67 aa, Artificial Sequence
  Computer-generated peptide variant
KMKFLRRFFRLIRREVQRLLVFKLKSAKADGGKVKKRAQLPSAALLLASLHLTFNRKRGNRRWHHLS

SEQ ID NO: 2740 - protein, 27 aa, Artificial Sequence
  Computer-generated peptide variant
ILRLFHRLWKKIQRASAHQIAVAKRNR

SEQ ID NO: 2741 - protein, 21 aa, Artificial Sequence
  Computer-generated peptide variant
FFRMYPKIFRWLKNARAKALR

SEQ ID NO: 2742 - protein, 52 aa, Artificial Sequence
  Computer-generated peptide variant
KYKWFRRYFKLLKNYRTKKAAVPYRRLLLFTKAHLAPRALKILDKVRLCRLI

SEQ ID NO: 2743 - protein, 56 aa, Artificial Sequence
  Computer-generated peptide variant
YLRLFRKWLRKFTRALAARIADFAWAYLHKSRAKKCANAMKLQKLHKLYVDAATVM

SEQ ID NO: 2744 - protein, 37 aa, Artificial Sequence
  Computer-generated peptide variant
FIRLYCKMFKYMNPRAHLLLAARLFVRNRCAKRKRAS

SEQ ID NO: 2745 - protein, 20 aa, Artificial Sequence
  Computer-generated peptide variant
IMRLLKKLLKMLKPQKMPLR

SEQ ID NO: 2746 - protein, 26 aa, Artificial Sequence
  Computer-generated peptide variant
FIRWFTKWWKRLRCARRLADLLKKAA

SEQ ID NO: 2747 - protein, 40 aa, Artificial Sequence
  Computer-generated peptide variant
RLKLLKKFFRFFTKYALWRKGRFARAFRHRYFYLKMKALA

SEQ ID NO: 2748 - protein, 60 aa, Artificial Sequence
  Computer-generated peptide variant
RWKLLRRMLKKFSKASKQLPCRALKLQDQCCLALPAMEIAFAMKKAARVQAKMPNLAGDG

SEQ ID NO: 2749 - protein, 35 aa, Artificial Sequence
  Computer-generated peptide variant
KLRILRKLLRKWSSMHRLIYMLIAAKRRFCAYTKL

SEQ ID NO: 2750 - protein, 100 aa, Artificial Sequence
  Computer-generated peptide variant
LFRMLTRLWRKYKRLHKHRLDRWSKRKMQAIAREKMRKLAHDPNPAMYLDTVHLDLILKTAMILRSMPILLEDKLARMRSPSARALLAALFRDPKKAVKA

SEQ ID NO: 2751 - protein, 27 aa, Artificial Sequence
  Computer-generated peptide variant
YWRMFRKLYKRMQRLALEQLHKALQLD

SEQ ID NO: 2752 - protein, 34 aa, Artificial Sequence
  Computer-generated peptide variant
FLKLLRKLFKLLRNQHEYSLKLVRVCLDTHLKRI

SEQ ID NO: 2753 - protein, 39 aa, Artificial Sequence
  Computer-generated peptide variant
RFKMFKRLLKRLKRLRPPTLQHLKAAQGYGAADKKLKPK

SEQ ID NO: 2754 - protein, 22 aa, Artificial Sequence
  Computer-generated peptide variant
ILKYLSRLLRKIKNRRLEDLMA

SEQ ID NO: 2755 - protein, 24 aa, Artificial Sequence
  Computer-generated peptide variant
RLRLMKKMLRYLPRLLKRTDQMLM

SEQ ID NO: 2756 - protein, 43 aa, Artificial Sequence
  Computer-generated peptide variant
RIRMMRRWMRKFKRRPAFMARYTLPLRSLYLAQLYWKRLLVNL

SEQ ID NO: 2757 - protein, 96 aa, Artificial Sequence
  Computer-generated peptide variant
RYKFMTRFLKKIQRLKSLLELDLKDALRFPKRRENLRRGNNHLKKDGELVKRARFVKLTAYWYKDRGARLALKWPKAPDVRLRMPRLGNAVAKKLY

SEQ ID NO: 2758 - protein, 92 aa, Artificial Sequence
  Computer-generated peptide variant
KLKWIPRLIKLIKNSDTNMLLTKRGALLADLQRMLDFVKAKMARRFARRAKHDEYLKGTKMHYAELDRIWKKSAARLRAKEKRNNRLDRRCC

SEQ ID NO: 2759 - protein, 47 aa, Artificial Sequence
  Computer-generated peptide variant
KLKLLRKWMRLLKSLALQVKFNKLRPLLDRQKYKKRPWAYRWTNLQN

SEQ ID NO: 2760 - protein, 37 aa, Artificial Sequence
  Computer-generated peptide variant
LYKFLHRYFRILRRVKCCLPKKRLKLKAHARLENKAP

SEQ ID NO: 2761 - protein, 82 aa, Artificial Sequence
  Computer-generated peptide variant
KMRFMRRLFRRFKRWKWYRTLRYHKQAAAPISARILKALRSAKLLMKRKLEAKLRLRKQKIQPVRAALKGKEAAIRIKPFVE

SEQ ID NO: 2762 - protein, 34 aa, Artificial Sequence
  Computer-generated peptide variant
LFKWFSRWFKWLKKAKLTWSLKTKARLHLNERKG

SEQ ID NO: 2763 - protein, 61 aa, Artificial Sequence
  Computer-generated peptide variant
KLKFLCKLMRKFHKAPRKCANRNPRRLRGAKVANEAKPHLLYGRGAVLKKALLTECLPLCL

SEQ ID NO: 2764 - protein, 76 aa, Artificial Sequence
  Computer-generated peptide variant
KLKLLSKMYKRLRCMGFVHCFKKRNKADACWLGAEKCFKLLLKYSALDDRKMNLKLARISTEAQLLASPLLLRRLK

SEQ ID NO: 2765 - protein, 59 aa, Artificial Sequence
  Computer-generated peptide variant
MLRILKKWMRLFRNFYLHLMTRLRIRLWKKKLCALFGKQEARYPRQLKKGNARCKDNKL

SEQ ID NO: 2766 - protein, 41 aa, Artificial Sequence
  Computer-generated peptide variant
LWRYLKRFMRMFPRLCRRRYWKAGALRQRPLSLELKKAKCS

SEQ ID NO: 2767 - protein, 47 aa, Artificial Sequence
  Computer-generated peptide variant
KLRMFSKFLKRFSHAPRRRLKATMLSRRNAIGNYAARDLLDNRRRAL

SEQ ID NO: 2768 - protein, 68 aa, Artificial Sequence
  Computer-generated peptide variant
RYRILHRLMRKIRNCFPDKLKLAFCEKLRRPAQQKEKLLAFKENHAMKPRRIKVANRDKQALNKLLDL

SEQ ID NO: 2769 - protein, 25 aa, Artificial Sequence
  Computer-generated peptide variant
RLRMLCRILKKYQKLKLLDNRKACN

SEQ ID NO: 2770 - protein, 94 aa, Artificial Sequence
  Computer-generated peptide variant
RIKFLTKLMKLYRRPYYFGKMLLCAKPWLRRAQITLARALVKDTDRRAVGYLKELFNRESKAYPRKARCRLLWHAKSYFQAKAKLEALEGLLLV

SEQ ID NO: 2771 - protein, 58 aa, Artificial Sequence
  Computer-generated peptide variant
KIRMLKKFIRRLHRQADFSRRELWLALACLMWCIRLTWECPASRAKLCALAKLARHAW

SEQ ID NO: 2772 - protein, 57 aa, Artificial Sequence
  Computer-generated peptide variant
RLKIFKRYWRLLKRIALPGAPRNKIVLDRRVNAAKQRLKRECLLDKTYHRKMEYDLA

SEQ ID NO: 2773 - protein, 29 aa, Artificial Sequence
  Computer-generated peptide variant
RLKLLCKLIKKLKRARHIGAAWKWVLQAR

SEQ ID NO: 2774 - protein, 63 aa, Artificial Sequence
  Computer-generated peptide variant
RFKLLRRIFKLFKPWNIRIAVVKDLADNKAPLQKNLFLKHALMKAAAGDLIKYRLRPPLAMLT

SEQ ID NO: 2775 - protein, 35 aa, Artificial Sequence
  Computer-generated peptide variant
KIRLFRRFFRKLKHRAVNALPLGLGVLKPEHAKKS

SEQ ID NO: 2776 - protein, 45 aa, Artificial Sequence
  Computer-generated peptide variant
MIKLLSKWWKFWTRKRLTWAFLKKSLCKATKRRKAKDALKIYCAL

SEQ ID NO: 2777 - protein, 39 aa, Artificial Sequence
  Computer-generated peptide variant
LFKFLRKILRRMRRTLRACRRQLRAIAIMGFEAQRYSAI

SEQ ID NO: 2778 - protein, 51 aa, Artificial Sequence
  Computer-generated peptide variant
IFRLFRRFWRMYKRRQAAGWCQKLRMAKHKLACRLKRWILALLFCTRRSRI

SEQ ID NO: 2779 - protein, 70 aa, Artificial Sequence
  Computer-generated peptide variant
FMKLFPRFLKRWRREKELACLMLNYLRSAWFDAELWSNELLLFRWTIAVLLRRFKHRKRSARSRAEAKKA

SEQ ID NO: 2780 - protein, 27 aa, Artificial Sequence
  Computer-generated peptide variant
LLRLLCRLFKRFKKKQSGNTLMVRFIL

SEQ ID NO: 2781 - protein, 39 aa, Artificial Sequence
  Computer-generated peptide variant
RLRLFKKFIRFYKQAKLWRAAKEAAHHLCWPSLVKVLCL

SEQ ID NO: 2782 - protein, 70 aa, Artificial Sequence
  Computer-generated peptide variant
LLKLLKKLFRMLCCGLVKEMRADGLKRTLWKKHKFTAQHQVAKIKLRKRARWLKGCAYLDRNDYKQKRVW

SEQ ID NO: 2783 - protein, 34 aa, Artificial Sequence
  Computer-generated peptide variant
KIKLLKKLIRKWKRYHERRALLARVNLPLQLVVE

SEQ ID NO: 2784 - protein, 21 aa, Artificial Sequence
  Computer-generated peptide variant
RLRLMHKYFKLIRKARLLCAL

SEQ ID NO: 2785 - protein, 92 aa, Artificial Sequence
  Computer-generated peptide variant
KIRWYKKMLKRLKTLIPFKLLRKRGNANPALLCRNKALMWCLKLDKLGLDDFIPWKSIMRNRFLNKLRARIRPLKWFTQKDLVALCALKKRC

SEQ ID NO: 2786 - protein, 24 aa, Artificial Sequence
  Computer-generated peptide variant
ILRIFHRYLRKIPKLWRAAAAKFH

SEQ ID NO: 2787 - protein, 38 aa, Artificial Sequence
  Computer-generated peptide variant
RWRLLKRYFRKLNRKLDPFTKNFLYLLSSRKVKKTAAA

SEQ ID NO: 2788 - protein, 41 aa, Artificial Sequence
  Computer-generated peptide variant
KFKWLRKIWRFIKCAYSRRAELALFLYHLKAAVHELARALW

SEQ ID NO: 2789 - protein, 59 aa, Artificial Sequence
  Computer-generated peptide variant
LYKWWRRMFRRLKKRQVVRESVAALAMAGGFLCEHHMKELRRTRHGRFKLLAKHAARLR

SEQ ID NO: 2790 - protein, 21 aa, Artificial Sequence
  Computer-generated peptide variant
FIRILHRLYRRYKKQLLWLAR

SEQ ID NO: 2791 - protein, 35 aa, Artificial Sequence
  Computer-generated peptide variant
LLRWLCKLWRYYQRWLLKIVRPAARDLAICLQNRR

SEQ ID NO: 2792 - protein, 90 aa, Artificial Sequence
  Computer-generated peptide variant
YYKFWKRIIKFMRKLTRKLDATPMRTLLKYELYSRIAHRARTEARAKKIARRALLCKKLMLKNGLDAFDRCGEGSCQKKAQNVLKKALKK

SEQ ID NO: 2793 - protein, 44 aa, Artificial Sequence
  Computer-generated peptide variant
FYKMYQRLLRILSPLKHRACLHIKLVREGKCLRLRKLRKYNRLN

SEQ ID NO: 2794 - protein, 20 aa, Artificial Sequence
  Computer-generated peptide variant
WFRLLTRLFRYLRKQKMLFR

SEQ ID NO: 2795 - protein, 48 aa, Artificial Sequence
  Computer-generated peptide variant
LLKYFRKFLKYMKRKCLRRLVCLLKYFKASLYCTELALLKEKSEAIRW

SEQ ID NO: 2796 - protein, 78 aa, Artificial Sequence
  Computer-generated peptide variant
RFKLFPRWYRRYKPARASARHKAARHPRLLALEARLHVFTSRRMRMKHLSAMELVLACIRKRRKQFRARLRKIRNALA

SEQ ID NO: 2797 - protein, 66 aa, Artificial Sequence
  Computer-generated peptide variant
IFRFLKRYLKRLKKVKNYPDVAKNRTEAFAYRHYILTAGTLVLRLRKIAREKDLKERQARKYALLF

SEQ ID NO: 2798 - protein, 55 aa, Artificial Sequence
  Computer-generated peptide variant
RFRLLRKFFRWLPHCKLAVWAKLKLALLKHWWALCVKFEKGRKDLASRTKPKRYW

SEQ ID NO: 2799 - protein, 39 aa, Artificial Sequence
  Computer-generated peptide variant
LYRFFKKYWRRMKHAKLERLVMLPRAKEWRALVVLWRAT

SEQ ID NO: 2800 - protein, 50 aa, Artificial Sequence
  Computer-generated peptide variant
IYKLLRRLFKWMKKAKKRMARCWRAILSGLLRRANARLLSAMYYRCAHWV

SEQ ID NO: 2801 - protein, 33 aa, Artificial Sequence
  Computer-generated peptide variant
FWRLIRKMFKKMKHKLALMAALLARFAARQLDC

SEQ ID NO: 2802 - protein, 60 aa, Artificial Sequence
  Computer-generated peptide variant
RIKLLKKMLKRFKTMLAYGMLACEAKCELCLGKKFRLITWLPRKRINRRWRIFARAQKYE

SEQ ID NO: 2803 - protein, 28 aa, Artificial Sequence
  Computer-generated peptide variant
KWRFFRKFLRLLQKHSRAKRLALGHLCP

SEQ ID NO: 2804 - protein, 22 aa, Artificial Sequence
  Computer-generated peptide variant
RFRLMNRIFKRFPKRLEAATLA

SEQ ID NO: 2805 - protein, 47 aa, Artificial Sequence
  Computer-generated peptide variant
KIRLFTRLIKFLKKANMRKGAKTRARRPRSLVYSAAHMPLCAMAYKA

SEQ ID NO: 2806 - protein, 29 aa, Artificial Sequence
  Computer-generated peptide variant
FLRLMRRLFKFFKRLSCETDAAGKAKWTA

SEQ ID NO: 2807 - protein, 61 aa, Artificial Sequence
  Computer-generated peptide variant
RYKLIQKIMRLFRTLKWSWTLAHFRGRLLGRLLRERKKKFEQRGWKCEAMLLSKLLKNRNK

SEQ ID NO: 2808 - protein, 71 aa, Artificial Sequence
  Computer-generated peptide variant
RLRWYRRFMRLFCNADLWRTLCHYVVLKTFCKLMCKAKPRHKKLAKLAKNLAMAYDMGARNKHVAAARRKA

SEQ ID NO: 2809 - protein, 61 aa, Artificial Sequence
  Computer-generated peptide variant
FLKLFNKFWRRLRCRLASQLAAKKRAFGMRYARLIIRWGKVRLHIMCKKCFPALDRKALLD

SEQ ID NO: 2810 - protein, 34 aa, Artificial Sequence
  Computer-generated peptide variant
RFRIMRRWYKLLHKGLHKAAKLRYALQKANRKAC

SEQ ID NO: 2811 - protein, 20 aa, Artificial Sequence
  Computer-generated peptide variant
WWRYMKRFFRRLKHLAKMLA

SEQ ID NO: 2812 - protein, 32 aa, Artificial Sequence
  Computer-generated peptide variant
RFKLYHRILRKLKKKARKVLDKANAFYPQSTL

SEQ ID NO: 2813 - protein, 44 aa, Artificial Sequence
  Computer-generated peptide variant
KMKIYRRFMKKFNRHLRGIIRKKALLKAAAAAEKRYKCAAAKHP

SEQ ID NO: 2814 - protein, 32 aa, Artificial Sequence
  Computer-generated peptide variant
KIKLFRRLLKRFRQRRVVAAARALVTNKWLYG

SEQ ID NO: 2815 - protein, 59 aa, Artificial Sequence
  Computer-generated peptide variant
LLKWWNRWLRILRRKAQLMTTKKLLCKALQLPDLQSLNDKAGMREDKGPARLPVLKKKG

SEQ ID NO: 2816 - protein, 48 aa, Artificial Sequence
  Computer-generated peptide variant
LFRLLQKFIRLIHNRKQPKYALKTKRTLFPVKLKIYLAALAHDRLERA

SEQ ID NO: 2817 - protein, 67 aa, Artificial Sequence
  Computer-generated peptide variant
RFRFLKRWMRRYHPMAVAAKRYPWPCPRSRLYKARGFNRKRALLYRAAARLDFLDKLQWAKAMHCIK

SEQ ID NO: 2818 - protein, 38 aa, Artificial Sequence
  Computer-generated peptide variant
KFKLLKRIIKLLRKLKHPHMYLMDIRALRANEFKTKTC

SEQ ID NO: 2819 - protein, 27 aa, Artificial Sequence
  Computer-generated peptide variant
RFKLLSRILRRLNRRYPALLTIRRYYV

SEQ ID NO: 2820 - protein, 54 aa, Artificial Sequence
  Computer-generated peptide variant
RFKFFRKIWRWLRRMLLTPASKNLALLLGLDWLAKFTLRAYNTSYLNNREARRK

SEQ ID NO: 2821 - protein, 48 aa, Artificial Sequence
  Computer-generated peptide variant
KWRFLNRMMKRYRKNLKIAANKTLMDLLYYIIAALSKKAKADKACSKG

SEQ ID NO: 2822 - protein, 33 aa, Artificial Sequence
  Computer-generated peptide variant
KLKYLPRWLKRFNCPMLWAIKFPAAKLKTKRKL

SEQ ID NO: 2823 - protein, 20 aa, Artificial Sequence
  Computer-generated peptide variant
YYRLMTKIYRRLKTTLLLDK

SEQ ID NO: 2824 - protein, 47 aa, Artificial Sequence
  Computer-generated peptide variant
KFRFIRKLYRKFQKAAAHEKFSANKAPKKLCGVLRGSAARLLDFNLA

SEQ ID NO: 2825 - protein, 66 aa, Artificial Sequence
  Computer-generated peptide variant
LFKLINKLLKLLCKICILLYLVLCCAKGEARALKKACHRDIAHAKDHKLYRHHYAIRDLYCKIARK

SEQ ID NO: 2826 - protein, 68 aa, Artificial Sequence
  Computer-generated peptide variant
LLKMFSKLLKLFQQHRCRRALLYERRKWQARLLDHNKHADGSLKERLPKKRANAELKQSLIFAKKKRK

SEQ ID NO: 2827 - protein, 20 aa, Artificial Sequence
  Computer-generated peptide variant
LLKLLKRWIKWWRKRLAVYS

SEQ ID NO: 2828 - protein, 35 aa, Artificial Sequence
  Computer-generated peptide variant
YIKLIRRLIKKIRRMNKTFAAALRPSLLKWHAGAY

SEQ ID NO: 2829 - protein, 40 aa, Artificial Sequence
  Computer-generated peptide variant
FWRFYNRLLKLLRHKAQYYRPIHCLLAARRAKQRVYKSWA

SEQ ID NO: 2830 - protein, 79 aa, Artificial Sequence
  Computer-generated peptide variant
KLRMWKKLFKMYTKPLLRSCRAVHWDAAYAHCHWPKALAQCRQAKKLAAALKRLKTYMVMRKIKLRKYMRMKHRARWLA

SEQ ID NO: 2831 - protein, 37 aa, Artificial Sequence
  Computer-generated peptide variant
YWKFLKRFMKKIRSCTKYAKALKQKALLKSALCPWAN

SEQ ID NO: 2832 - protein, 43 aa, Artificial Sequence
  Computer-generated peptide variant
IIKLINRYLRIIRKLPLWVLEAGRAKAKKAWTGKLRFSMAAKW

SEQ ID NO: 2833 - protein, 61 aa, Artificial Sequence
  Computer-generated peptide variant
KLKFIRKLLRRLKPCLLVWMLAQNLARSMGLYAKREIYRKLLKEGFAVLACLQMTGKQYKK

SEQ ID NO: 2834 - protein, 91 aa, Artificial Sequence
  Computer-generated peptide variant
RYRFYQRLLKYFKKLRPLTGTAMKTAALSKRLQAPGNAFVADKLRPWKRKKIKEIKLKKTFVELHLNMKKKLMQAAYMRRTCCLALILLRK

SEQ ID NO: 2835 - protein, 56 aa, Artificial Sequence
  Computer-generated peptide variant
MLKFLPKFWKRFQKKRDLSAAYELAQKRKRLGLFAHEACGTWCCYATLKRRRRLKL

SEQ ID NO: 2836 - protein, 38 aa, Artificial Sequence
  Computer-generated peptide variant
LYRLFNRFLRRFKKYLRNARAALAGSIKKCQGYKPCKA

SEQ ID NO: 2837 - protein, 41 aa, Artificial Sequence
  Computer-generated peptide variant
RWKMLKKMFRKLCPRANRTDKQLRFATNTLFKLYLLPRKVL

SEQ ID NO: 2838 - protein, 41 aa, Artificial Sequence
  Computer-generated peptide variant
LLRFFHRMWRKMKRDLKCKHWAAHVYLLLLQAKLWRRIRGL

SEQ ID NO: 2839 - protein, 26 aa, Artificial Sequence
  Computer-generated peptide variant
FYKLLRRIIKYFKKAAPALLDYRKKT

SEQ ID NO: 2840 - protein, 48 aa, Artificial Sequence
  Computer-generated peptide variant
KYKILKKWWKLWHKLQRNELRIHKILARANHLFKTLLLALLLKLKKAH

SEQ ID NO: 2841 - protein, 25 aa, Artificial Sequence
  Computer-generated peptide variant
KYRLWKKLIKRLTKGVMIANCLAMR

SEQ ID NO: 2842 - protein, 43 aa, Artificial Sequence
  Computer-generated peptide variant
LLRFFCKIMKRFKTLKKVLLKLLAAHRYSAAEPEPHLYLYRVA

SEQ ID NO: 2843 - protein, 43 aa, Artificial Sequence
  Computer-generated peptide variant
KLKLLRKFLKRWRTEGKQYKYLYLDYAHKILHRIFALKRQKLN

SEQ ID NO: 2844 - protein, 91 aa, Artificial Sequence
  Computer-generated peptide variant
RIRLFKRILRYMPKFRERQKCSTKKARLLAAKKMAEAYLEGAWAASQLKAARLEARSREPIPRAIALNTRFNNRRWAYRFLQLRELAMMAH

SEQ ID NO: 2845 - protein, 41 aa, Artificial Sequence
  Computer-generated peptide variant
KLRYLKKLFRKYHKQARFAHEIKCLCRKNPKAARRLARLGP

SEQ ID NO: 2846 - protein, 29 aa, Artificial Sequence
  Computer-generated peptide variant
LLRFWRKIIRRLRRALEIFGFLMALHRRK

SEQ ID NO: 2847 - protein, 96 aa, Artificial Sequence
  Computer-generated peptide variant
FIKWMRRWLKKINCRREFKARFELLRRMRPRRRTQLKKLCGAKKANLCLRLALPYKRFHHKRRAKATEVNLRLRAFWQLQLPKRRYHALCADRVRA

SEQ ID NO: 2848 - protein, 23 aa, Artificial Sequence
  Computer-generated peptide variant
FFRFLTKLLKRFKQHVKKAGALV

SEQ ID NO: 2849 - protein, 53 aa, Artificial Sequence
  Computer-generated peptide variant
KYRLLPRWLKRMKKRLNLCLKAKGIRLDKQLNRAYYMTCSVYMKHPKATKLAL

SEQ ID NO: 2850 - protein, 60 aa, Artificial Sequence
  Computer-generated peptide variant
WWKMLCRLLKRIRRRWLARMAKSRLLKLQSRSKADLKLARASKAKHIWDRSLKIRLAFLT

SEQ ID NO: 2851 - protein, 49 aa, Artificial Sequence
  Computer-generated peptide variant
KLRFIKKFWRRLRTHLFKARKNAARKGARKLMKLALETNGAKFYMSVYI

SEQ ID NO: 2852 - protein, 40 aa, Artificial Sequence
  Computer-generated peptide variant
MLKLFCRFYRKYRRLKRFRRLMLAILLLLRLQNYFNHLRF

SEQ ID NO: 2853 - protein, 24 aa, Artificial Sequence
  Computer-generated peptide variant
RLKLLKKLFKLLRTTVVRLCYRAC

SEQ ID NO: 2854 - protein, 64 aa, Artificial Sequence
  Computer-generated peptide variant
LIRLFKKMLKMFRPYGRAADARSCLDIADYLLVDWVKARFKGRAGLCLSEAKRANRAAVLRKPK

SEQ ID NO: 2855 - protein, 95 aa, Artificial Sequence
  Computer-generated peptide variant
RLKMLKKYLKKMRTKVKCHRPMIARKPPKRNARAFLARHAAAYKDMEAAKSRHRFMRLIDDRIYKPRRRKIARLILCMDLSRPAERDLKQYSAHL

SEQ ID NO: 2856 - protein, 38 aa, Artificial Sequence
  Computer-generated peptide variant
FLRILQKLFKRLQKKAAKLALMYKRHNLPPWIAFTRAL

SEQ ID NO: 2857 - protein, 86 aa, Artificial Sequence
  Computer-generated peptide variant
IIKFFCKIWKLMTNKMARKRFYLKARASPAALALAMHSAAKKVTVRALHEKRELLVALFRHLLFRFPKYKLALAWGERLNMRLQRE

SEQ ID NO: 2858 - protein, 73 aa, Artificial Sequence
  Computer-generated peptide variant
KLRFWRRWMKLLKPYLYRARGSNQYPKLNLAAKAIWGVKRINVKAVSHRELLDLKLRAVLAKHEKRHVCRALL

SEQ ID NO: 2859 - protein, 23 aa, Artificial Sequence
  Computer-generated peptide variant
YFRFLKKWYKRLKRKILAAVLQW

SEQ ID NO: 2860 - protein, 21 aa, Artificial Sequence
  Computer-generated peptide variant
MLKLLSKFYKRIRRPMGKTAL

SEQ ID NO: 2861 - protein, 25 aa, Artificial Sequence
  Computer-generated peptide variant
LLKMYKRWYKLYNTRIYLKLAKQQR

SEQ ID NO: 2862 - protein, 76 aa, Artificial Sequence
  Computer-generated peptide variant
LIKFLRRWLRKLKTGNRAPMRERDRYRRVAIQCARLTLRALMFTFRAAQFLRKYAAGPAVVDRAKARIARKKYCYR

SEQ ID NO: 2863 - protein, 48 aa, Artificial Sequence
  Computer-generated peptide variant
MYKLLRRFIKRFQPQNYIAADALVFALALKKYFRRKALKARRLKRIFT

SEQ ID NO: 2864 - protein, 35 aa, Artificial Sequence
  Computer-generated peptide variant
LLKLLKKYLKKMKQAIAPNLQESRTALAVKSKLIW

SEQ ID NO: 2865 - protein, 58 aa, Artificial Sequence
  Computer-generated peptide variant
YFKYLSKLLKRWRHAEALYQRAALLDKLKRKDMKQLAHLEFLFHWKLLGATSQDTRKR

SEQ ID NO: 2866 - protein, 24 aa, Artificial Sequence
  Computer-generated peptide variant
FFKLMRRWWRFLKHHQARKAEAAR

SEQ ID NO: 2867 - protein, 42 aa, Artificial Sequence
  Computer-generated peptide variant
KMRLFRKFLRKLRSHFEMWDMQLLRLQQKAASYVLKRLQKAR

SEQ ID NO: 2868 - protein, 64 aa, Artificial Sequence
  Computer-generated peptide variant
YMRLWKRMFKLMRHKRYAMGTPKLKASILLLRIAKNCKRGRRCTGRWDLVRRNAKLAKALRWLQ

SEQ ID NO: 2869 - protein, 28 aa, Artificial Sequence
  Computer-generated peptide variant
ILRLFRKYFKRLRHMYHAKRPAATLWRA

SEQ ID NO: 2870 - protein, 54 aa, Artificial Sequence
  Computer-generated peptide variant
LFRFFRRWLRKLNKRDMKRMTLARALDVKLARQAVSYICKCEQAHRVAASARYL

SEQ ID NO: 2871 - protein, 31 aa, Artificial Sequence
  Computer-generated peptide variant
LLKLITRMLKKYRKIYAHRFAILPLKRELVD

SEQ ID NO: 2872 - protein, 29 aa, Artificial Sequence
  Computer-generated peptide variant
RIRLFRRLLKMFHCDRHATARLKAAADLT

SEQ ID NO: 2873 - protein, 50 aa, Artificial Sequence
  Computer-generated peptide variant
RFRMFRKLYRLICKLALMWAWACTLMRARIERARPALHRKWLCQLNAHWA

SEQ ID NO: 2874 - protein, 29 aa, Artificial Sequence
  Computer-generated peptide variant
LWRWLTKIWKRYQKKDFAILLAMRHRAHK

SEQ ID NO: 2875 - protein, 48 aa, Artificial Sequence
  Computer-generated peptide variant
MLKMYPKLLRFMQKAATLRFKKRNYWDKHAFCIKKSGLERLLKLLPLL

SEQ ID NO: 2876 - protein, 80 aa, Artificial Sequence
  Computer-generated peptide variant
FLKLLRKLYRKFKKKSTLSHLKVEKIDNQCLRLLALDMRYAVLRIKKSKGKAFWACTPLPKLKFAHLANLVPRKMFRRPL

SEQ ID NO: 2877 - protein, 40 aa, Artificial Sequence
  Computer-generated peptide variant
RYRWLRRYLKIFKSEFSIAACYELRATARCRKPKRQLRAV

SEQ ID NO: 2878 - protein, 28 aa, Artificial Sequence
  Computer-generated peptide variant
KFRYWTRLFRRLRTLMHILAAKRLEPRA

SEQ ID NO: 2879 - protein, 79 aa, Artificial Sequence
  Computer-generated peptide variant
WYKLLTRLLKKFKKAHAKKAEALVFDRLKYTQINLKARVAKWNNVFSGRWMAKRSRKAGKRRWLNDSKWTALRKLNVRR

SEQ ID NO: 2880 - protein, 53 aa, Artificial Sequence
  Computer-generated peptide variant
MLKLFTKIMRMYKRRVKKVKCLNTKYLRIMAMEKKPRKTFHLLHHAALLLAAL

SEQ ID NO: 2881 - protein, 37 aa, Artificial Sequence
  Computer-generated peptide variant
LLRYYPKLFKLIKSAPKHSRLFRQLNWKAAYSAAKKK

SEQ ID NO: 2882 - protein, 54 aa, Artificial Sequence
  Computer-generated peptide variant
LYRYLRRWLKLLRRRRAWEWFTYLRTLIMRVKLKGAHCHVFLWLRALREHVNLA

SEQ ID NO: 2883 - protein, 27 aa, Artificial Sequence
  Computer-generated peptide variant
LLRMFKKLFRRFRPAPLFRRHKAQELW

SEQ ID NO: 2884 - protein, 47 aa, Artificial Sequence
  Computer-generated peptide variant
MMKFLRRFFKRLRKQKASLRAKLMKALWDNWMKRTCRSMPTILASKA

SEQ ID NO: 2885 - protein, 29 aa, Artificial Sequence
  Computer-generated peptide variant
KLRIFRKFMRLLTRKNRRFADGLLCLCGF

SEQ ID NO: 2886 - protein, 36 aa, Artificial Sequence
  Computer-generated peptide variant
RIKLFPKLIRMFCCALTSGALALEPKLCKRLAEKFR

SEQ ID NO: 2887 - protein, 22 aa, Artificial Sequence
  Computer-generated peptide variant
YFKFYRKLLRLMNCRRHLRKLL

SEQ ID NO: 2888 - protein, 21 aa, Artificial Sequence
  Computer-generated peptide variant
RLRLMSKLFRRLNKCDQRTNL

SEQ ID NO: 2889 - protein, 43 aa, Artificial Sequence
  Computer-generated peptide variant
LLRIWSRLLKKMRNAKNARPLARSRIRMKGESVYIKRLLNLMQ

SEQ ID NO: 2890 - protein, 35 aa, Artificial Sequence
  Computer-generated peptide variant
KIKFMTKIFRMFRKARLSLKLPASLLRNLAHKFFL

SEQ ID NO: 2891 - protein, 72 aa, Artificial Sequence
  Computer-generated peptide variant
KLRFFNKYFKRIRCMAKLGRKALFAEQYDAKTGPLAKAPVLLKFRRSLQRKNDLKCYDALFMRAWRTKLEKL

SEQ ID NO: 2892 - protein, 32 aa, Artificial Sequence
  Computer-generated peptide variant
IMKFIRKLFKFLQCRVMKKLALRHKLWLCHAR

SEQ ID NO: 2893 - protein, 34 aa, Artificial Sequence
  Computer-generated peptide variant
FFKWLRKIFRLLRKTLRRCLRLVWYKDADRFAGA

SEQ ID NO: 2894 - protein, 29 aa, Artificial Sequence
  Computer-generated peptide variant
LYRLFKRWYRKMKKHALLTRELLKLDKPN

SEQ ID NO: 2895 - protein, 45 aa, Artificial Sequence
  Computer-generated peptide variant
KLKYWKRFFKRWRKYRFAPAYRKVLKKDLGRILFAMLSNLLPWGA

SEQ ID NO: 2896 - protein, 43 aa, Artificial Sequence
  Computer-generated peptide variant
KMRLLPRLIKRFKNKKKFLAPNSLKKLLDWGLLLYRLARYWHL

SEQ ID NO: 2897 - protein, 97 aa, Artificial Sequence
  Computer-generated peptide variant
YLKFMRRWWRRIKKANADFCLYKLRRKLLIAKLHAINALRNKGKSKLRLRELHTYSRRAKRHRMCLACANSDRCCLFLRRLLLIIAIRDMLKVAKND

SEQ ID NO: 2898 - protein, 32 aa, Artificial Sequence
  Computer-generated peptide variant
KFRLFRRLYRRLQHAARFMHPRPKTLAKKALL

SEQ ID NO: 2899 - protein, 45 aa, Artificial Sequence
  Computer-generated peptide variant
RLKFFRKWLRRWCSLLIRILFRLPRLRWKLKLGPKKRACMVWSFL

SEQ ID NO: 2900 - protein, 32 aa, Artificial Sequence
  Computer-generated peptide variant
IMRLYNRIFRYLPKLTLKVLALKLARKKKLLS

SEQ ID NO: 2901 - protein, 44 aa, Artificial Sequence
  Computer-generated peptide variant
ILKLLHKMFKRLNRTKLKALALQIAIQCARDQAVKCNLKKKMRD

SEQ ID NO: 2902 - protein, 57 aa, Artificial Sequence
  Computer-generated peptide variant
KIRLLKKMFKLFCTTALRLILKRWRQRLQATWRWILLEGNACAYRKLWLREAAATRY

SEQ ID NO: 2903 - protein, 31 aa, Artificial Sequence
  Computer-generated peptide variant
WLRFYKRLYRILHKRAQVSVYSLKRALALAK

SEQ ID NO: 2904 - protein, 62 aa, Artificial Sequence
  Computer-generated peptide variant
KLRMLRRFWRRFRPAELANLLRRMLLRQLAWLHKDHTLQAMKQYVLKTKRLLKLTVKLAMYK

SEQ ID NO: 2905 - protein, 56 aa, Artificial Sequence
  Computer-generated peptide variant
RLKLLRKFLRKLHKRVAALSEVMDKFTLAKARAKSDKRGRIATDSFETMKHLRAFR

SEQ ID NO: 2906 - protein, 62 aa, Artificial Sequence
  Computer-generated peptide variant
FLKLIKKLMKRYRKNVAAQEFRLKLKKGRRLMLARRAVRKVHHLDMLDKGLAIWAPLGAARL

SEQ ID NO: 2907 - protein, 31 aa, Artificial Sequence
  Computer-generated peptide variant
KLKFLSRWFRKLNRPAMHAKLRADGFKLQAH

SEQ ID NO: 2908 - protein, 40 aa, Artificial Sequence
  Computer-generated peptide variant
FFRWIRKLLKRLSHLKALVNFRRILTALRENALKKAYISA

SEQ ID NO: 2909 - protein, 23 aa, Artificial Sequence
  Computer-generated peptide variant
RFKFLTKLLRLFKKIKSYNFAYA

SEQ ID NO: 2910 - protein, 20 aa, Artificial Sequence
  Computer-generated peptide variant
WFRWLRKFLRLMKNNRACML

SEQ ID NO: 2911 - protein, 27 aa, Artificial Sequence
  Computer-generated peptide variant
LLKLLRRFFKKIKRKQAEKLGVNADVA

SEQ ID NO: 2912 - protein, 31 aa, Artificial Sequence
  Computer-generated peptide variant
YLRLWRKLLRRYKKDHRAKYPDLAHIIKLRS

SEQ ID NO: 2913 - protein, 59 aa, Artificial Sequence
  Computer-generated peptide variant
LWKYMPRLMRLWRKPKAEFKLCLLKNMANKAFEQGKRHRKKARWGSLLLRKYAANALGR

SEQ ID NO: 2914 - protein, 22 aa, Artificial Sequence
  Computer-generated peptide variant
LFRFWCKLFRRFTTKLKLLLAA

SEQ ID NO: 2915 - protein, 47 aa, Artificial Sequence
  Computer-generated peptide variant
KFKLMKKLFKRIQKVHLGLKLGEELECRLLAKASRRWAGLRCARGCR

SEQ ID NO: 2916 - protein, 75 aa, Artificial Sequence
  Computer-generated peptide variant
RIKLMRRYIRKLPKQGTRKKTATAALQLAARLLAHDKFRLACPLGYLRERDNKTQRFAMKTKARLKASRREDDNA

SEQ ID NO: 2917 - protein, 28 aa, Artificial Sequence
  Computer-generated peptide variant
LFKFLKRLFKKLHNLAYRLRRLKKHELE

SEQ ID NO: 2918 - protein, 40 aa, Artificial Sequence
  Computer-generated peptide variant
MLKLLCRLFKRFKKRQAALEALDRRDRYTRLHRKHPLCCM

SEQ ID NO: 2919 - protein, 33 aa, Artificial Sequence
  Computer-generated peptide variant
RIKWWKKMLKKLSKVRAALMQALKYLKKWPIRA

SEQ ID NO: 2920 - protein, 61 aa, Artificial Sequence
  Computer-generated peptide variant
KYKLFQRLIKRMTKKGLKRALAPSKKMGLPFRNPLLAYACAREAKVLNRLVMEFKAGAPLL

SEQ ID NO: 2921 - protein, 64 aa, Artificial Sequence
  Computer-generated peptide variant
FLKFIQRILKRWKCQLLCSDARKAAAAKARSLKCACWQYKWKGRLYRASALCKAYKAQRNDKLF

SEQ ID NO: 2922 - protein, 54 aa, Artificial Sequence
  Computer-generated peptide variant
RFRILKKFLKRMKQQRKQFLTNWRAPLTGHLFRAKILRPGRLLLLKDHLATDKR

SEQ ID NO: 2923 - protein, 36 aa, Artificial Sequence
  Computer-generated peptide variant
RMKWYQRFLRKIHPHALLDNKDWKALLRKLCKRTKL

SEQ ID NO: 2924 - protein, 39 aa, Artificial Sequence
  Computer-generated peptide variant
KLRYYKKLFRKLRRLRCGLKKHIAAMLYETNGAMIAVKT

SEQ ID NO: 2925 - protein, 29 aa, Artificial Sequence
  Computer-generated peptide variant
RMRMLTKFIRFYRRARLAADRLAERRACL

SEQ ID NO: 2926 - protein, 46 aa, Artificial Sequence
  Computer-generated peptide variant
IMKFMRRIIRYIRKLLLRRARSMMTMKHGLMLLPLQAARKLLKAIA

SEQ ID NO: 2927 - protein, 27 aa, Artificial Sequence
  Computer-generated peptide variant
KIKLLHRLLKFIRKRISVAERGLARRL

SEQ ID NO: 2928 - protein, 25 aa, Artificial Sequence
  Computer-generated peptide variant
LFRIMKKFYRLLPRLKELKCLMSKH

SEQ ID NO: 2929 - protein, 49 aa, Artificial Sequence
  Computer-generated peptide variant
KLKLLKRMLKLYRRKSRNWNAWLSYMKMPLPLADLLRKAQIRLGFFTNK

SEQ ID NO: 2930 - protein, 23 aa, Artificial Sequence
  Computer-generated peptide variant
LLKFMSKLFRLLRRTEVKPRKLF

SEQ ID NO: 2931 - protein, 20 aa, Artificial Sequence
  Computer-generated peptide variant
MMRLYHRLFKKMRTWALLNR

SEQ ID NO: 2932 - protein, 25 aa, Artificial Sequence
  Computer-generated peptide variant
LWKMLCRYYKRLRKLRWVANVWKAP

SEQ ID NO: 2933 - protein, 29 aa, Artificial Sequence
  Computer-generated peptide variant
MLKMFKRYWRLIRSRAYWPARLRALVYRD

SEQ ID NO: 2934 - protein, 40 aa, Artificial Sequence
  Computer-generated peptide variant
RIKWMCKYLKYMRRKQLLLADQRRLLLKLKEAKATSKIPC

SEQ ID NO: 2935 - protein, 20 aa, Artificial Sequence
  Computer-generated peptide variant
RLRLLRRIFRYYRRNLMNDL

SEQ ID NO: 2936 - protein, 82 aa, Artificial Sequence
  Computer-generated peptide variant
LWRLFRRWLKRMRKAKKKLARKNCRCKCAQRPRMHIHNRRARFAPMRKYPKDWVKYTWAKARYTHRQLAARARCTLLCAAAV

SEQ ID NO: 2937 - protein, 28 aa, Artificial Sequence
  Computer-generated peptide variant
WLRFIRRLYRKLKRRMLLSIELKLAHVF

SEQ ID NO: 2938 - protein, 83 aa, Artificial Sequence
  Computer-generated peptide variant
LLRFFSRLLKRLNRKLLGARAEASTAHQKSYGNEVFARAARRLLWRRLAVRKLKENETTAMAYWSCPLYAKKAMYECCALRVR

SEQ ID NO: 2939 - protein, 27 aa, Artificial Sequence
  Computer-generated peptide variant
FLKLLKKYIKRMRNWAFMALVFVKRAT

SEQ ID NO: 2940 - protein, 70 aa, Artificial Sequence
  Computer-generated peptide variant
RFRILCRWWRLFTRKRAALEIANHLWYAKYERKRHRQRRLARWRECFKRLSNLRKPRKRPLLYLTDLPMF

SEQ ID NO: 2941 - protein, 24 aa, Artificial Sequence
  Computer-generated peptide variant
LYRFMTKLIRLLKTNPAAILAIRR

SEQ ID NO: 2942 - protein, 20 aa, Artificial Sequence
  Computer-generated peptide variant
KLKILTKWIKILPRPLAPKF

SEQ ID NO: 2943 - protein, 24 aa, Artificial Sequence
  Computer-generated peptide variant
RFKFFQRLMRLLHKVYKALTLRVA

SEQ ID NO: 2944 - protein, 23 aa, Artificial Sequence
  Computer-generated peptide variant
RYKLLHRWFRKMPRCLLAREMAK

SEQ ID NO: 2945 - protein, 50 aa, Artificial Sequence
  Computer-generated peptide variant
FFRLICKFLKRYPKKHCALKKDALILLKGKAKLNKSACAKQVLPARWYPR

SEQ ID NO: 2946 - protein, 31 aa, Artificial Sequence
  Computer-generated peptide variant
KMRLWKRILRRLRRAKLAYCNKTEMHLACRL

SEQ ID NO: 2947 - protein, 43 aa, Artificial Sequence
  Computer-generated peptide variant
RLKLWRRFFKKLKRAVADFRKMRTRVLFCTRWLTLAAIYWKSG

SEQ ID NO: 2948 - protein, 81 aa, Artificial Sequence
  Computer-generated peptide variant
WFKLWRRFLRWLKRKKGMVAKLAATQRLHAQACHEERLQVCKLAREKADIGRRREKTLKWLPEKAMLCRRYRAAIKASFGL

SEQ ID NO: 2949 - protein, 32 aa, Artificial Sequence
  Computer-generated peptide variant
YLRWFRRLLKYIQKAVYKALKALGKTLGLERK

SEQ ID NO: 2950 - protein, 40 aa, Artificial Sequence
  Computer-generated peptide variant
YFRMLKKYIKFLRKAAVAKHLAALRLIHLKVLMRVGLRRL

SEQ ID NO: 2951 - protein, 22 aa, Artificial Sequence
  Computer-generated peptide variant
RYRLMTKLIRRLRQRSPTASAA

SEQ ID NO: 2952 - protein, 28 aa, Artificial Sequence
  Computer-generated peptide variant
RFKFMKKILKYLKKLKTRLWAKKALAGA

SEQ ID NO: 2953 - protein, 36 aa, Artificial Sequence
  Computer-generated peptide variant
LYRLFQKLLRKMQKRRLCAAHQYRADFKLEILDPQR

SEQ ID NO: 2954 - protein, 32 aa, Artificial Sequence
  Computer-generated peptide variant
FLKLFRKLLRMLSKNTLKKRALKKAWRWKYDM

SEQ ID NO: 2955 - protein, 35 aa, Artificial Sequence
  Computer-generated peptide variant
KIKLLTKLWRLLKRIFKRLAFCRCAAHNESAILLK

SEQ ID NO: 2956 - protein, 45 aa, Artificial Sequence
  Computer-generated peptide variant
LWRLMCRLIKRIHRCDLVRKRNLPLLLLQKLHDLAHDHLKRLAMH

SEQ ID NO: 2957 - protein, 77 aa, Artificial Sequence
  Computer-generated peptide variant
LLRWLQRFMRRLRKKLRRTKLRKCIEKCDPCRAILAPNAKACTYKNDSKAFDRARTDVQLGQLAPMLVVKRALAAAV

SEQ ID NO: 2958 - protein, 26 aa, Artificial Sequence
  Computer-generated peptide variant
KLRFLKRYFKKFPRLAVLADAAQQKT

SEQ ID NO: 2959 - protein, 54 aa, Artificial Sequence
  Computer-generated peptide variant
RFRFFQKILRKIKHLLLLAAMKNKDDLLQDKFATKMKHDGLAARLLRVAVNSLM

SEQ ID NO: 2960 - protein, 24 aa, Artificial Sequence
  Computer-generated peptide variant
LLKMFRKLFRMLKRLPDALTQACE

SEQ ID NO: 2961 - protein, 37 aa, Artificial Sequence
  Computer-generated peptide variant
KMRLMCKILRLLTTAHIRLLRSKINRYRELAYALKKA

SEQ ID NO: 2962 - protein, 69 aa, Artificial Sequence
  Computer-generated peptide variant
WLKFLKRLLRRFRHLKSPPRHIGRRQDHAMMLSLRKKVLWNELYLYENGWMALKKLILRLCKCAKLRWA

SEQ ID NO: 2963 - protein, 35 aa, Artificial Sequence
  Computer-generated peptide variant
RFKWLCKLWKLLKQAKAYSAVKREAYCWLKVKLLE

SEQ ID NO: 2964 - protein, 22 aa, Artificial Sequence
  Computer-generated peptide variant
LFRLMRKLWRLLNRLKLNIAKA

SEQ ID NO: 2965 - protein, 96 aa, Artificial Sequence
  Computer-generated peptide variant
RMKIYRKLLKYIRKLARKIERQCHKNAFLPEQLGAPKLKNYPIMALRAWAADIFKRPERKRKSKRLDSRKRWYLIAAAFCRKNSSLRARAMWLLHR

SEQ ID NO: 2966 - protein, 21 aa, Artificial Sequence
  Computer-generated peptide variant
KYRFYRRLWKKFRQQLVALAI

SEQ ID NO: 2967 - protein, 38 aa, Artificial Sequence
  Computer-generated peptide variant
RLRFYQKFMRRLRHKLARWTWALRMRWLKSKAQLAVRM

SEQ ID NO: 2968 - protein, 50 aa, Artificial Sequence
  Computer-generated peptide variant
RLKILRRFMKFLRSIACQKEFAAERKRNLLHPLADERKIRIARAAARTAM

SEQ ID NO: 2969 - protein, 36 aa, Artificial Sequence
  Computer-generated peptide variant
RWKLIQKLMKRWQPKLLAELWRAANPLATPKARQRK

SEQ ID NO: 2970 - protein, 54 aa, Artificial Sequence
  Computer-generated peptide variant
LIKYFNRLFKKMRNRRRGYAILRAALNQNAMKKKAFLKWCCFMLALCSLNFARR

SEQ ID NO: 2971 - protein, 94 aa, Artificial Sequence
  Computer-generated peptide variant
RFRMLHRILRLLRKMRKAHHNNLYQERRKGKQRFMCDCALSAARCKGMLNMYTLKYKPTRKARVKLLCCLVKKEKAKKMAAAGAKYGDLLRTHR

SEQ ID NO: 2972 - protein, 96 aa, Artificial Sequence
  Computer-generated peptide variant
RFRLIKKFFKKFKSDATLAIGKLRRALAMVKRKLNRIWYARYPRVCSKELKFLCMAIIKLKVTAETWDAAVKAPALRLLVKKYREMLARMAHGARG

SEQ ID NO: 2973 - protein, 41 aa, Artificial Sequence
  Computer-generated peptide variant
KMRFLPKYMRRLQNQRKKRIVPALLKCCAADSWLAKKMELR

SEQ ID NO: 2974 - protein, 49 aa, Artificial Sequence
  Computer-generated peptide variant
YFKILRRLLKRMNRSADAQASSKAARKHRKWELSAKKWARYQLCSSMTL

SEQ ID NO: 2975 - protein, 66 aa, Artificial Sequence
  Computer-generated peptide variant
KMKYLRRWIKKLCSREDLNLNPLRRMLLLLRFKGKAITYASWGAPRLAIATSKPRAPAAKAKYFWL

SEQ ID NO: 2976 - protein, 26 aa, Artificial Sequence
  Computer-generated peptide variant
LLRFFNRWIKYLNTLKWILKFRRAAK

SEQ ID NO: 2977 - protein, 22 aa, Artificial Sequence
  Computer-generated peptide variant
FLRLIQRMLKKYKSKLKLCVLN

SEQ ID NO: 2978 - protein, 22 aa, Artificial Sequence
  Computer-generated peptide variant
RLKLLKRLIKLFNKLCKLPDKR

SEQ ID NO: 2979 - protein, 25 aa, Artificial Sequence
  Computer-generated peptide variant
LFKFLHRMLRRLKRMKTGYAAKKAT

SEQ ID NO: 2980 - protein, 56 aa, Artificial Sequence
  Computer-generated peptide variant
KIKWFPKMYRFWRKEKCAKRHLKQLRKSLLRLEAMPQMLADLLQENHKRTARKAMA

SEQ ID NO: 2981 - protein, 32 aa, Artificial Sequence
  Computer-generated peptide variant
RWKLIKRLLKRYTRRYAGAKEACCDGARAARR

SEQ ID NO: 2982 - protein, 25 aa, Artificial Sequence
  Computer-generated peptide variant
RLKWLPKWYKRLRRKYLKLWALFLW

SEQ ID NO: 2983 - protein, 94 aa, Artificial Sequence
  Computer-generated peptide variant
RLKLLQKWMKKLRKLEMSIAAPLACEGDLIHCQKAHSYLIKDILVRLHRIFRGRRHLKALMRLLKLRNRCARKKQAAVETKCSKDKQATVKKDR

SEQ ID NO: 2984 - protein, 80 aa, Artificial Sequence
  Computer-generated peptide variant
LFKLWPKLLKRLRRNFKQHRRHFKFKFSWKYLCLCTKLAFMSTLMRLCLWKKLKKAAGALRDYCKKPASRKLMRFAFRKK

SEQ ID NO: 2985 - protein, 26 aa, Artificial Sequence
  Computer-generated peptide variant
RLKLFRKLLKLFQHARWLKQKQGRPD

SEQ ID NO: 2986 - protein, 73 aa, Artificial Sequence
  Computer-generated peptide variant
KWRFLRKLLKFLRKKLPCKRKAVIRAQACARHKKCWAWLIKAPNDRVADLRYDLWTVRIRNLAALYQKKKPIR

SEQ ID NO: 2987 - protein, 41 aa, Artificial Sequence
  Computer-generated peptide variant
LYRLMKRWYRKLKHHLAKAARFRALYTSLRATHKHVVLREL

SEQ ID NO: 2988 - protein, 50 aa, Artificial Sequence
  Computer-generated peptide variant
FIRYLPKWWKYWTKPQLLRAKKRPLNKRRARVLTLAAIFKLKTNARSSAS

SEQ ID NO: 2989 - protein, 56 aa, Artificial Sequence
  Computer-generated peptide variant
FFKYFCKLMRRLRRWEFKQFLKNRDLKRRKQYLARGKCPSAERTKLFHAAIAALPL

SEQ ID NO: 2990 - protein, 54 aa, Artificial Sequence
  Computer-generated peptide variant
LWRWLKRWLKRYNKPKLEDWHFATRWAWLAKRCMKGKRRYRQLVRLRGRLLELG

SEQ ID NO: 2991 - protein, 42 aa, Artificial Sequence
  Computer-generated peptide variant
FMRMYHKWLKRLKKIKPASQAVERLKARYLRAVADHKKSLLN

SEQ ID NO: 2992 - protein, 42 aa, Artificial Sequence
  Computer-generated peptide variant
RLRFLRKMLKWLCRDKLLIKRAHVTQKKLLAVLNMAGKRAAA

SEQ ID NO: 2993 - protein, 71 aa, Artificial Sequence
  Computer-generated peptide variant
RMKLLQKIWKRLPRKRMKNMRLKFHLKDKKKCALVLRRFKALRLEKAYAVCSAIWGRKERLSANRALRECT

SEQ ID NO: 2994 - protein, 37 aa, Artificial Sequence
  Computer-generated peptide variant
LMKLFNKFMKLYCKKKLNLLEMRRLAKRAIMIHAAKL

SEQ ID NO: 2995 - protein, 24 aa, Artificial Sequence
  Computer-generated peptide variant
WLRWLKRFFRFLQKLLHARKVRQP

SEQ ID NO: 2996 - protein, 36 aa, Artificial Sequence
  Computer-generated peptide variant
RFKLLKKYLRIFTCLEAALLGKTKFRRVPANKAIEQ

SEQ ID NO: 2997 - protein, 36 aa, Artificial Sequence
  Computer-generated peptide variant
FLKWLKKMIRLLKRKALAYKMDRAKKILKHDLWVKS

SEQ ID NO: 2998 - protein, 50 aa, Artificial Sequence
  Computer-generated peptide variant
LLRFWKRLYRKLPNALCDWCTLLKAKGAKAVLIKRFRHLHAKVNRERNKN

SEQ ID NO: 2999 - protein, 43 aa, Artificial Sequence
  Computer-generated peptide variant
ILRYLKKYFRKLRNWKRSANRCLRYIQARLCLARGGDLEHHRL

SEQ ID NO: 3000 - protein, 27 aa, Artificial Sequence
  Computer-generated peptide variant
LWKILKKYLKRLPNVKPEKLLLCKLAL

SEQ ID NO: 3001 - protein, 45 aa, Artificial Sequence
  Computer-generated peptide variant
KIKLLKKLLRRFSSPAQRAGIHQKKICDYTRLGNKLSKARAACLM

SEQ ID NO: 3002 - protein, 28 aa, Artificial Sequence
  Computer-generated peptide variant
LLRLLRRLMRKWRRLSRHANMRARYDPA

SEQ ID NO: 3003 - protein, 42 aa, Artificial Sequence
  Computer-generated peptide variant
FLRLLRRMIRRFKRHYMAFAALVRWVWHLREAKALLLNGYRT

SEQ ID NO: 3004 - protein, 83 aa, Artificial Sequence
  Computer-generated peptide variant
RFKMWQKLMRRWRCKRRIAALWKRAYKRKYKDRLKKRNQLRAPRSAIMRFQALMLRLYLGQVQLENSARKTHLMLTFRRALYN

SEQ ID NO: 3005 - protein, 90 aa, Artificial Sequence
  Computer-generated peptide variant
FIRFLKRLLKKLRRCRLYLYAHRRRYVNLRKTDIKAKTKFAPTAKALLQKLKAACRIYMGFKKLIRLLLAGLWFAVHKKRFASRKLRLYR

SEQ ID NO: 3006 - protein, 63 aa, Artificial Sequence
  Computer-generated peptide variant
FLKLFKKLWRKFSRRREELPPTRQFPIAPKLHLRRMICKAYARKEKCATLEDAARLARSRLLI

SEQ ID NO: 3007 - protein, 77 aa, Artificial Sequence
  Computer-generated peptide variant
RWKFWCKFYKRYKRRADKRKAKLLLASMKKAKRANYKSAKFKLPVAYCVALIRTLCIAANLQTTSHALRFDCRFYRR

SEQ ID NO: 3008 - protein, 24 aa, Artificial Sequence
  Computer-generated peptide variant
IIRILKKLWKKLRPRATMRLLRCA

SEQ ID NO: 3009 - protein, 33 aa, Artificial Sequence
  Computer-generated peptide variant
LLRYLCKWLKRISTLKLRIRRLFGNDAAPMLPL

SEQ ID NO: 3010 - protein, 34 aa, Artificial Sequence
  Computer-generated peptide variant
WFKILNRFLRRYRKLKRLLRAWRAAMRLEAKLRG

SEQ ID NO: 3011 - protein, 36 aa, Artificial Sequence
  Computer-generated peptide variant
KWKMFHRIFRRLKRGKQLKLEGLAARLQTLFFKDAP

SEQ ID NO: 3012 - protein, 20 aa, Artificial Sequence
  Computer-generated peptide variant
RLKWLTKFLRMYNHRRLDLR

SEQ ID NO: 3013 - protein, 42 aa, Artificial Sequence
  Computer-generated peptide variant
KWRFISKWFRRYRRFKLLKDAAHDVTLLAHTLRRKAMRHAKV

SEQ ID NO: 3014 - protein, 28 aa, Artificial Sequence
  Computer-generated peptide variant
LLKLFRRLLRKYHCCAKKLTWTDARKAL

SEQ ID NO: 3015 - protein, 33 aa, Artificial Sequence
  Computer-generated peptide variant
RLRLFNKWLRKLTHARINDVEAAKRKKLKEGAG

SEQ ID NO: 3016 - protein, 62 aa, Artificial Sequence
  Computer-generated peptide variant
RYRFLRRYLRKLQRHRMVRAHLAFQMKRKPKQKKELRGLMGVLLYCELWTHARLYAAKIKIL

SEQ ID NO: 3017 - protein, 54 aa, Artificial Sequence
  Computer-generated peptide variant
MLKYLKRLIKWLHCQPFGASLWKHRKKIARLAHKPKKACMKATRANLGKAANKR

SEQ ID NO: 3018 - protein, 33 aa, Artificial Sequence
  Computer-generated peptide variant
RYRLWRKYLRILRQKGLYMKRATAPLALAATKL

SEQ ID NO: 3019 - protein, 28 aa, Artificial Sequence
  Computer-generated peptide variant
KFRLLKKFFRRMHCAVVKLLQLQVLTRK

SEQ ID NO: 3020 - protein, 89 aa, Artificial Sequence
  Computer-generated peptide variant
RLKFFTRILKKFQTMLPLAQRHRLLCYRKVARAECLEEKLNVKCKERLQDAWRQRYKKLLCRLGKKLLFNFKSCDLHKAVLICKLTAAK

SEQ ID NO: 3021 - protein, 47 aa, Artificial Sequence
  Computer-generated peptide variant
WIRLLCKFFKKLHCSEEAKAIAASRLRKQKYRRCAFLLLFRDGQARS

SEQ ID NO: 3022 - protein, 44 aa, Artificial Sequence
  Computer-generated peptide variant
LIRLLQKLYRRLKHAKFWRKQPHHAQRAVKVLIMLKEAKGLHWL

SEQ ID NO: 3023 - protein, 32 aa, Artificial Sequence
  Computer-generated peptide variant
RFRLITKLLKRLKRKACKRRNLKDAVLTIAGC

SEQ ID NO: 3024 - protein, 51 aa, Artificial Sequence
  Computer-generated peptide variant
RWKILRKFLRKLRQLNAMLYAALNWNCMKADLSNARLRAEKEYGLLKIEIR

SEQ ID NO: 3025 - protein, 49 aa, Artificial Sequence
  Computer-generated peptide variant
KLKFFRRLMKLLRNQWTLALKRYKHDLKVPRKHKQPLGLLMQGREYAGL

SEQ ID NO: 3026 - protein, 76 aa, Artificial Sequence
  Computer-generated peptide variant
RIRLIQRLIRRMRQLALLIADKNQAIGLAKHRAAFLHLRLKKSLLGRFTASKPGGAEVISVWANAKARLRLMGKVW

SEQ ID NO: 3027 - protein, 93 aa, Artificial Sequence
  Computer-generated peptide variant
KFKWLTKLLKMMRRKKMILMACLNQYRAMPWLARYRLELLKLADGYFNPKKRAASQAEHKRADPWLRPGAALAWLFRLKVRHLAVNKKACKNW

SEQ ID NO: 3028 - protein, 48 aa, Artificial Sequence
  Computer-generated peptide variant
RFKLLRKFLKKYQRANLEFAKVWRWRNKRKQRWREASAALVPLHIAKV

SEQ ID NO: 3029 - protein, 81 aa, Artificial Sequence
  Computer-generated peptide variant
KWRFIQRLWKLFPKMDRHNKLRGWLTGAYKLNLLAKLDRAWNKMILIVRLVRRAPKLVVRAIYKLATAYLKLALPWDRLAK

SEQ ID NO: 3030 - protein, 32 aa, Artificial Sequence
  Computer-generated peptide variant
LIKIYKKLWKILRRCRLEKGFALPGKAAELSI

SEQ ID NO: 3031 - protein, 26 aa, Artificial Sequence
  Computer-generated peptide variant
FYRWMRRLYRKIRRQLKAIAAHALRM

SEQ ID NO: 3032 - protein, 40 aa, Artificial Sequence
  Computer-generated peptide variant
KLKFIHKLWRRFKKHTCAWKKAAVLPLKLCHVKLSKKVSE

SEQ ID NO: 3033 - protein, 98 aa, Artificial Sequence
  Computer-generated peptide variant
KWRLLKRFIRLMCKRLLRPLRAWWDRMMLFKKRKHSAVWHANAHQRKRKPVRLKRYYRRKVLLRFLSFAVLRKENNEGMILFAAQLKFFCLSLRTRAC

SEQ ID NO: 3034 - protein, 28 aa, Artificial Sequence
  Computer-generated peptide variant
RFKMLRRILKFLQRLRKSCLALKADSWN

SEQ ID NO: 3035 - protein, 25 aa, Artificial Sequence
  Computer-generated peptide variant
LIRLMRRFYRLFNHLRKQAVASPRA

SEQ ID NO: 3036 - protein, 40 aa, Artificial Sequence
  Computer-generated peptide variant
IFRFYQRLLRRMKSCQHSLAKEIYTECLKRLRKRARAKLL

SEQ ID NO: 3037 - protein, 70 aa, Artificial Sequence
  Computer-generated peptide variant
YFRLLSRYLKMFRKKVRKLAALHALSLAKAIKCYFLLANCRVMLKCAEATKGAAKPKHTGAPWIRLVWRR

SEQ ID NO: 3038 - protein, 27 aa, Artificial Sequence
  Computer-generated peptide variant
KMRLYQRMLKRYKKLLMGGLWRADVLA

SEQ ID NO: 3039 - protein, 59 aa, Artificial Sequence
  Computer-generated peptide variant
KLKFLRKYIRKFTRAKSKRARAQRYWATFLNRMRHATWALEQEKLRRVAARNKVKLHLY

SEQ ID NO: 3040 - protein, 46 aa, Artificial Sequence
  Computer-generated peptide variant
FLKLFKKYMRRWRRRGWRYAIYAGLRAALVLPIRKPQRKWVAKHLW

SEQ ID NO: 3041 - protein, 21 aa, Artificial Sequence
  Computer-generated peptide variant
MLKYFQKWLRRFKKTALYAFR

SEQ ID NO: 3042 - protein, 61 aa, Artificial Sequence
  Computer-generated peptide variant
LFRLLRRLFRRFKRQHLQAHYWAWWLAAKIRMGWCKARFKKKLALLRVRERCAAYLAKHPA

SEQ ID NO: 3043 - protein, 30 aa, Artificial Sequence
  Computer-generated peptide variant
RLRLWRRLWKLWHPGRNKQKAKAHKALNSC

SEQ ID NO: 3044 - protein, 39 aa, Artificial Sequence
  Computer-generated peptide variant
LLRIFTRWLKRFKKPLAAAAALLRVSHLLHMKRMHKKLP

SEQ ID NO: 3045 - protein, 54 aa, Artificial Sequence
  Computer-generated peptide variant
LLRWLRKLLKLYQKHQKSELYLSRLFFKKVRMRRYLQQEKRWGLPARRMIILCK

SEQ ID NO: 3046 - protein, 50 aa, Artificial Sequence
  Computer-generated peptide variant
KFRFFKRLFKKLRNFQAAAWLMKETAQKEALCKLKNCLIKSIWLKHLLRA

SEQ ID NO: 3047 - protein, 39 aa, Artificial Sequence
  Computer-generated peptide variant
MWRLWSKLLRKFHKKRVRWAALSCLLRAKNKKIYSEKHA

SEQ ID NO: 3048 - protein, 21 aa, Artificial Sequence
  Computer-generated peptide variant
YLKMWNKMYKLYKRRRHAALL

SEQ ID NO: 3049 - protein, 99 aa, Artificial Sequence
  Computer-generated peptide variant
KLRMICKLLRFLRQMRRLRVGDGACRKLMLLQLKWKCKPNPRWLAQLRANRLELEALLLALGLILRLERRFNKCWLKAAVTVYRMYLRKPRYLRRRHVM

SEQ ID NO: 3050 - protein, 78 aa, Artificial Sequence
  Computer-generated peptide variant
KWRFLRKLYRRYRKPARYVKNLAAFATRRKRRMAGRLAMFYPQRKANFPGRRGSIAAIRIAKERFVAATRSFEQLKLW

SEQ ID NO: 3051 - protein, 41 aa, Artificial Sequence
  Computer-generated peptide variant
LMRLYKRIYRKYRKAAAKIVAEKVYTSPKDLRKLALLPMAS

SEQ ID NO: 3052 - protein, 29 aa, Artificial Sequence
  Computer-generated peptide variant
RLKLWKKFWRIFSHDKLHLDLPYLRTAAR

SEQ ID NO: 3053 - protein, 38 aa, Artificial Sequence
  Computer-generated peptide variant
KLRYFRRLLRLFCKSPRADNKRLSPPGLCRVGSRPARL

SEQ ID NO: 3054 - protein, 36 aa, Artificial Sequence
  Computer-generated peptide variant
KLKLFKKWLRKMRRLIFADTLLPTRDKQKAHALNTK

SEQ ID NO: 3055 - protein, 50 aa, Artificial Sequence
  Computer-generated peptide variant
KYKLFKKLLRWWKKGLVRLDLLLKLRATLAWLKYAMKPCRSPLAAAKQSG

SEQ ID NO: 3056 - protein, 38 aa, Artificial Sequence
  Computer-generated peptide variant
LYKFLSKFWRLYTKLHHNDARNGKLRPANKLMLKKAAL

SEQ ID NO: 3057 - protein, 40 aa, Artificial Sequence
  Computer-generated peptide variant
FLRMLNRLYKYIRSKWARDAFTKRWRKKMLIAAHKIMKEL

SEQ ID NO: 3058 - protein, 26 aa, Artificial Sequence
  Computer-generated peptide variant
KFKILQKLWRRLRRAEAVAFATKEML

SEQ ID NO: 3059 - protein, 78 aa, Artificial Sequence
  Computer-generated peptide variant
MFKIINKLYKYLHQACKPLRLHRPIKLRSRMARYSAWATVLEAWRARLLIRSAALKAMMMPRARPKGRRRRRQHGARQ

SEQ ID NO: 3060 - protein, 45 aa, Artificial Sequence
  Computer-generated peptide variant
KLRLMHKLWRKLRCHGFVATAHTLKCEARLAKIKLLRRAALCRYA

SEQ ID NO: 3061 - protein, 66 aa, Artificial Sequence
  Computer-generated peptide variant
FFKWLHKYLRYFRRLKKKYLDALLLRHNKRAWFLFLLFNTGIAKHAFLNLLARRKKQGRLMLGAGG

SEQ ID NO: 3062 - protein, 65 aa, Artificial Sequence
  Computer-generated peptide variant
LLKFYKKILRLWHRRAMAHVIDAKLPRKKAIRWDTARLAPKYDKLANELKSKATRTLEATLRAKG

SEQ ID NO: 3063 - protein, 29 aa, Artificial Sequence
  Computer-generated peptide variant
MIKYLSKFIKKWKRNAKIIAKAAIDARLL

SEQ ID NO: 3064 - protein, 22 aa, Artificial Sequence
  Computer-generated peptide variant
FLKLLRKMLKLMRKIGIPAIRR

SEQ ID NO: 3065 - protein, 36 aa, Artificial Sequence
  Computer-generated peptide variant
LLKLIKKYLKFLRHNTKHLLLLGTRRYYAQRVLRYL

SEQ ID NO: 3066 - protein, 43 aa, Artificial Sequence
  Computer-generated peptide variant
RIRFFKRMLKKYKRAHDARDYALKSPAAFRNLYFYAKDKRALR

SEQ ID NO: 3067 - protein, 43 aa, Artificial Sequence
  Computer-generated peptide variant
RWKLYKKLWRRFTRQGWKFRKQERLNCMGLCLRLRLKLNWCLA

SEQ ID NO: 3068 - protein, 30 aa, Artificial Sequence
  Computer-generated peptide variant
RYRLLKKFMRLWNKCVLYLKLANLHKAEIK

SEQ ID NO: 3069 - protein, 43 aa, Artificial Sequence
  Computer-generated peptide variant
MWKLFQKLLKLYRRRKLMYMFKLRRDKQFLKRLWALARHKKLG

SEQ ID NO: 3070 - protein, 40 aa, Artificial Sequence
  Computer-generated peptide variant
KLRLLKRLLKFFKSFLRNACAGAAARQRRTMGQDKATTKI

SEQ ID NO: 3071 - protein, 45 aa, Artificial Sequence
  Computer-generated peptide variant
RWKLFKKFLKRFRRARSIAAALKLARAIWKVKWVRAKAKSLSHIF

SEQ ID NO: 3072 - protein, 39 aa, Artificial Sequence
  Computer-generated peptide variant
RLRFMPRLLRRFKKRTVLLAALWDQKYNDYKPRRLQVAD

SEQ ID NO: 3073 - protein, 56 aa, Artificial Sequence
  Computer-generated peptide variant
WYRWLRKLWKRLRKQLDWRTKNVWFKLSAASAAGRDRPLKLALYACWYRKKMRAWK

SEQ ID NO: 3074 - protein, 78 aa, Artificial Sequence
  Computer-generated peptide variant
RLKLFKRFLKKYKHKSKVTINRILRTCAANWAAKARRKRQPACLEMSKRFLAAWLKRARAKLKAMIACGKAMRTAKMH

SEQ ID NO: 3075 - protein, 42 aa, Artificial Sequence
  Computer-generated peptide variant
KLRFYKRIWKLLKKPFASCCLPNQLLRRQFNQANKARAACAL

SEQ ID NO: 3076 - protein, 26 aa, Artificial Sequence
  Computer-generated peptide variant
KLRWFKKWFRLFQRLDPILVAAILKK

SEQ ID NO: 3077 - protein, 42 aa, Artificial Sequence
  Computer-generated peptide variant
RYRFLKKFLKKLRPQLVKDKMKWLCNAKKLKAGVACRDLQRA

SEQ ID NO: 3078 - protein, 68 aa, Artificial Sequence
  Computer-generated peptide variant
ILKLIKRMFKFLCNRKADLKRATKVLRCKALPRKAQDSYRLAWAWARAKKEALQQQYALHQFLKLRQY

SEQ ID NO: 3079 - protein, 43 aa, Artificial Sequence
  Computer-generated peptide variant
ILKFLQRLYKRLHHGTPTMKRAKYRARLRELAEKCILGCKLIA

SEQ ID NO: 3080 - protein, 32 aa, Artificial Sequence
  Computer-generated peptide variant
FYKFYRKMLKLIKRNKRRLGALLKRAHYMNQA

SEQ ID NO: 3081 - protein, 22 aa, Artificial Sequence
  Computer-generated peptide variant
WLKMLHKFFKRLKRALSMCRPL

SEQ ID NO: 3082 - protein, 90 aa, Artificial Sequence
  Computer-generated peptide variant
RWKYLSKLIRRFRQIAGLVKRLRMRDKIICLRDYARNNASAICKLLAGLHALMAAMLYQAARARFREPKWRYQRNAGLLAKTPRDRRFGA

SEQ ID NO: 3083 - protein, 81 aa, Artificial Sequence
  Computer-generated peptide variant
KIKLLKKLLRRICKINNHAKKYDNFKPTRTLKQRLKCMKKFDLVLASTAMCNGMAWAMGHQDHRRGALLRKAARQLAARAK

SEQ ID NO: 3084 - protein, 63 aa, Artificial Sequence
  Computer-generated peptide variant
WWRMYKRLLKMLHSRIWQLNAALRRPAYALCKRSFAAGKFRLMEWHAEKEHRKMRRLKKAGER

SEQ ID NO: 3085 - protein, 50 aa, Artificial Sequence
  Computer-generated peptide variant
KLKMFSRYMRRFRTRPLRLLPLQLHAYRMIWMCMRKAKLPRIAALKDKRV

SEQ ID NO: 3086 - protein, 52 aa, Artificial Sequence
  Computer-generated peptide variant
WFKYMKKFLKKLQNKGLRLIMEILRWKSMAKGLRLAFYICRKARASAAATAW

SEQ ID NO: 3087 - protein, 71 aa, Artificial Sequence
  Computer-generated peptide variant
YWRFFSRIWRRLRPCRNLYAGLKEKLNLANAECDAFDKWPFIRKRLAKRKIKAAKLKRLDERFDAPRALRR

SEQ ID NO: 3088 - protein, 55 aa, Artificial Sequence
  Computer-generated peptide variant
FLKMYPKMYRIWRRVCRQFMLRTAAQREAKLLAPARNRYPMAALALWKRLLLAKK

SEQ ID NO: 3089 - protein, 70 aa, Artificial Sequence
  Computer-generated peptide variant
KMKWLKKFLRFYRKNEKLAQRKRRLFLRPKGAVKELCDKLATLRVSEMRCACAKAYKRKLKLLHENHLSL

SEQ ID NO: 3090 - protein, 22 aa, Artificial Sequence
  Computer-generated peptide variant
RMRLWTRILKMYKKNAKLGAQA

SEQ ID NO: 3091 - protein, 66 aa, Artificial Sequence
  Computer-generated peptide variant
RFKFLRRMIKLLQPCLRRRLYGKARCLCHKAPIKLGLKDRGANARKKALPACAFSAQMGQKHRRFR

SEQ ID NO: 3092 - protein, 55 aa, Artificial Sequence
  Computer-generated peptide variant
KYKLMRRLLKWMKTMKRAWSRAEWRKYRLTAALHVRLFKRKRSWPEYLNKEANLA

SEQ ID NO: 3093 - protein, 32 aa, Artificial Sequence
  Computer-generated peptide variant
FFRLFKKFYKWYHKLLVAKKSERLMPKLDARL

SEQ ID NO: 3094 - protein, 49 aa, Artificial Sequence
  Computer-generated peptide variant
MLKFYRRLIRRLNREAPRERILAEFKERAWRCRRFAALLCALNLSKNAT

SEQ ID NO: 3095 - protein, 43 aa, Artificial Sequence
  Computer-generated peptide variant
RYRLMPRWYKMFQTACLPLLEVRTSRRRLLVLLALKKRCRTLR

SEQ ID NO: 3096 - protein, 56 aa, Artificial Sequence
  Computer-generated peptide variant
LFRIFQRLFKRLQHSRAMRFSRRKYKYHRMLFRDELNRRLLDLLLRHVTKALKPKQ

SEQ ID NO: 3097 - protein, 68 aa, Artificial Sequence
  Computer-generated peptide variant
KIKWFKKIFRYLTKHLRLLKWLKRVWKERKPMLFDLAKSRAANQYWALRSQQKAAIRLRAYAKKIKYM

SEQ ID NO: 3098 - protein, 70 aa, Artificial Sequence
  Computer-generated peptide variant
WLKFLSRLLKKMSRAAADMWKRQNSMRRTLIKYAKGKKYSAIWRALRKRDRLKAMWLCFLRIKSVPKGDK

SEQ ID NO: 3099 - protein, 83 aa, Artificial Sequence
  Computer-generated peptide variant
KLRIMKRLMKRITHAKKKMRALVQLKCIQLLRNFACRKRRLNNMHFKIDRPAARAPLPQNRALSLLRVLNPKVQKRGWLKAPM

SEQ ID NO: 3100 - protein, 86 aa, Artificial Sequence
  Computer-generated peptide variant
KLRFYKRFYKILKPTRVGVAKYLAYKAYALADKASRCPRAKRRKPTTALLRNQRKIKASADKRRNILRKIRTLELKARKWWAYAWL

SEQ ID NO: 3101 - protein, 20 aa, Artificial Sequence
  Computer-generated peptide variant
WFRILRKLLKRWKNDLPRAC

SEQ ID NO: 3102 - protein, 32 aa, Artificial Sequence
  Computer-generated peptide variant
MFRLFRRFLRKLNPFQRRLLFRGLIECAKKYA

SEQ ID NO: 3103 - protein, 49 aa, Artificial Sequence
  Computer-generated peptide variant
LWRFLRRFMRFWKREAEAKARFKRADVMIKAKLIRLSRLATQLENRWPF

SEQ ID NO: 3104 - protein, 25 aa, Artificial Sequence
  Computer-generated peptide variant
KFRLLPKLFKFLRRLYLHSFRPAIM

SEQ ID NO: 3105 - protein, 91 aa, Artificial Sequence
  Computer-generated peptide variant
KMKFLSRLLRIFKRSAPGIRWDNARDERRALKAWNKCKAQAAAKKERAPTLNWQMAIAWLKHKPLALMRCSAAEKDLRAAAHIRMYLYPLR

SEQ ID NO: 3106 - protein, 77 aa, Artificial Sequence
  Computer-generated peptide variant
RFKLISKLLRRFRPRDRWRLKAKKRTRAAWAALKGEYEARRRWSCLHATAWQLFWELKERRKILLRLCSMRAKNDRK

SEQ ID NO: 3107 - protein, 58 aa, Artificial Sequence
  Computer-generated peptide variant
KMKFLHRMWKILKSDRAFCQQKYRLADLARRQPLCLLKKKWPLCKAVATFAGMLKLFA

SEQ ID NO: 3108 - protein, 55 aa, Artificial Sequence
  Computer-generated peptide variant
KLRFIKRLYKKLRKLPYKRKHLKMYARAHNFGNNGLVCLKLKFHDKDLMCALKRY

SEQ ID NO: 3109 - protein, 42 aa, Artificial Sequence
  Computer-generated peptide variant
WLRLWKRLFKFLPRKAAKKKKLLRIHPSLKIKRAYAHMMDNA

SEQ ID NO: 3110 - protein, 45 aa, Artificial Sequence
  Computer-generated peptide variant
LMKLFKKYLRKIRSAKLAFFDSMARAPCQRHRNLCKAGLCRLGRM

SEQ ID NO: 3111 - protein, 31 aa, Artificial Sequence
  Computer-generated peptide variant
IMRLIRRFLKKIQQILIRAALLMCRRCKVKA

SEQ ID NO: 3112 - protein, 29 aa, Artificial Sequence
  Computer-generated peptide variant
KLRLLRRLLKRYNHIKRPDTYEHAIFARG

SEQ ID NO: 3113 - protein, 27 aa, Artificial Sequence
  Computer-generated peptide variant
LLKFMRKLWKMLHRKCLAAQAVWHSRR

SEQ ID NO: 3114 - protein, 92 aa, Artificial Sequence
  Computer-generated peptide variant
MMKYLRKWFKWIKKALALLAEKPADRDAQRAACKRAFQCRMAADGRQLGWTEHRGKNCRNLRWDQKALNRGCMGAALRRKRLSPKWLKNLLA

SEQ ID NO: 3115 - protein, 60 aa, Artificial Sequence
  Computer-generated peptide variant
YLRWLKRLFRFIKCALGWKIHVALPRQNLIGEEARGKLALTLYRKSVDKLLKLLWLMKHK

SEQ ID NO: 3116 - protein, 80 aa, Artificial Sequence
  Computer-generated peptide variant
KLKLYRKMMRRIKRRLRDAKAAKDLAYLGEWLKWKKCPPFVAFGISQDANYKALGHLCKRLLIKFPKRLKRLALNAMQHI

SEQ ID NO: 3117 - protein, 45 aa, Artificial Sequence
  Computer-generated peptide variant
FIRMYRKMLRKINRKLWSYHKATRWAFLLDARAQGKADRRLKAAF

SEQ ID NO: 3118 - protein, 28 aa, Artificial Sequence
  Computer-generated peptide variant
RMKLLSRLLKKFRQKLLMLHNIRDKPAS

SEQ ID NO: 3119 - protein, 36 aa, Artificial Sequence
  Computer-generated peptide variant
RFRMLTKMLRLWRRCRLEKAIAPLLYRMKLYRMKHS

SEQ ID NO: 3120 - protein, 20 aa, Artificial Sequence
  Computer-generated peptide variant
RLKLWKKWLKRFNHVSVLLS

SEQ ID NO: 3121 - protein, 59 aa, Artificial Sequence
  Computer-generated peptide variant
FLRLITRWIKLFPHYKCAVDINKCLRIKEIRKIAAAKYRLCRLRARLLLAHARISLTLN

SEQ ID NO: 3122 - protein, 33 aa, Artificial Sequence
  Computer-generated peptide variant
IFRWWNRLLRKLKRGLASLAAKTGLADLRYKDV

SEQ ID NO: 3123 - protein, 76 aa, Artificial Sequence
  Computer-generated peptide variant
KFRMLTKFLRKFRRLKMNLKWADSKKYRTAAGLLVKHDIRKHMRHFFLRRFARARFMYPRLFSMGAALRAKLEHRN

SEQ ID NO: 3124 - protein, 70 aa, Artificial Sequence
  Computer-generated peptide variant
MYRMFRKILRFIRKKETMQNLLLKDDLYHKCRLRQRRWLRLLHLLWLGPKRFACAAKLAQYKDKEAALAQ

SEQ ID NO: 3125 - protein, 25 aa, Artificial Sequence
  Computer-generated peptide variant
FLRWFKKLFKKFSPALKLDLRGQRL

SEQ ID NO: 3126 - protein, 67 aa, Artificial Sequence
  Computer-generated peptide variant
RIKMWRKFYKILHKFYPQLKPTFHLIACSKALQDLKKKNKILMCVVAKKLAEAKGKAVLKRRLANAL

SEQ ID NO: 3127 - protein, 96 aa, Artificial Sequence
  Computer-generated peptide variant
WMKIMKRLFKRLQCKLMARCRIREHTRKIRCAKLKRKLLFLHKKNRLKAPSWCKRTALAQQLLWLCRRMFCEYASRAYPERLAQLLTGDMAGKARI

SEQ ID NO: 3128 - protein, 88 aa, Artificial Sequence
  Computer-generated peptide variant
FWRIFRKLLRMLHRHVKKKAFTQLKSALALITLCHSRLRKPIACPLARKAEKPLLCAKAESDLLLAAAFRHWWLGRIGLKYLNQPKLK

SEQ ID NO: 3129 - protein, 26 aa, Artificial Sequence
  Computer-generated peptide variant
KLRYLRRMLKKLKKLHAWMVGLVARK

SEQ ID NO: 3130 - protein, 30 aa, Artificial Sequence
  Computer-generated peptide variant
KYRLLKRLFRKWKHMLWSAKCVKLKLFIGD

SEQ ID NO: 3131 - protein, 24 aa, Artificial Sequence
  Computer-generated peptide variant
FLKWISRLMRLLRHKRKEALHLHP

SEQ ID NO: 3132 - protein, 56 aa, Artificial Sequence
  Computer-generated peptide variant
RFRWMKRLIKIYRRKKRNMFARQLTAAARINAPRAKALNAKACRGELGLLTINSAA

SEQ ID NO: 3133 - protein, 58 aa, Artificial Sequence
  Computer-generated peptide variant
KLKYFHRLLKRLKKLGRAVVLKHMNQHKLHTCRREALARRGRREEAIEAALFLYAAPR

SEQ ID NO: 3134 - protein, 28 aa, Artificial Sequence
  Computer-generated peptide variant
FFKLFNKWYKRLKRLRQLLRVLCAAEFY

SEQ ID NO: 3135 - protein, 41 aa, Artificial Sequence
  Computer-generated peptide variant
LFRIMSRLLRFLKQAQAVLTPKLAKVADAERRIEWRRAPLC

SEQ ID NO: 3136 - protein, 65 aa, Artificial Sequence
  Computer-generated peptide variant
KLRFWTKLLKKLRCLPNAKRDYLLAKWLDARKHQHLKCVMLLLMHFWRHKIGLRKRPNRWKMIKN

SEQ ID NO: 3137 - protein, 40 aa, Artificial Sequence
  Computer-generated peptide variant
FLKLLRKMLRRFHQANEARVCKVLAKRALCKKLLRCRLIA

SEQ ID NO: 3138 - protein, 42 aa, Artificial Sequence
  Computer-generated peptide variant
KLRYIKRLFKKYQCLKSLKRYRAKGSRPAPLVANDRAHWLDL

SEQ ID NO: 3139 - protein, 71 aa, Artificial Sequence
  Computer-generated peptide variant
KLRLYKKFFRIYKKRQVQRKRRHFGAPLAKRWAPAAVPLRLLIARHKCAQLTSLNVSLCLVHKLLSKCFRK

SEQ ID NO: 3140 - protein, 31 aa, Artificial Sequence
  Computer-generated peptide variant
KLRLLCKILRRLTTMFCKADAMLMRFRRDRE

SEQ ID NO: 3141 - protein, 60 aa, Artificial Sequence
  Computer-generated peptide variant
KLRFLRKLLKMFRRWNLWLNPASNDNLHLATARARKGLRMGLKHAKALIKENDWLERVDA

SEQ ID NO: 3142 - protein, 76 aa, Artificial Sequence
  Computer-generated peptide variant
KMRFFSRLFRRLKQQLAFLRKTRKTDAAKKTRRKLRELVAMKYMLIAWRAEPRKKLAGPMKDKVLLAVTLRVKAMQ

SEQ ID NO: 3143 - protein, 96 aa, Artificial Sequence
  Computer-generated peptide variant
KIRFYTKLLKLLKRRGTAKAILYPAHKSISGKTRHMLRPYSRFLMALPRHGLLKKLIAAAAAPVAAIRACGLRARRFKVFRIQPKKLDREKLDAIY

SEQ ID NO: 3144 - protein, 23 aa, Artificial Sequence
  Computer-generated peptide variant
KMRLIRRLLRMFPKQLASAPSAR

SEQ ID NO: 3145 - protein, 20 aa, Artificial Sequence
  Computer-generated peptide variant
KLRFLSRWLKRYTPKAHCAK

SEQ ID NO: 3146 - protein, 35 aa, Artificial Sequence
  Computer-generated peptide variant
LLKILTKIYRFWRQAYKAFFARTLQRKLHSGKKLA

SEQ ID NO: 3147 - protein, 32 aa, Artificial Sequence
  Computer-generated peptide variant
RWKLYKKLLKMICSLSFAGALKCRRRLCEERT

SEQ ID NO: 3148 - protein, 98 aa, Artificial Sequence
  Computer-generated peptide variant
LIRYFTKLLRRMRPLKRIKLKFKRRIQRRLLFIRLRDKALSMLRMRHAMAAGLHKICKIERDGKALTCFRRRFVDAKHFCYLLIAARLKNLRAVQRFP

SEQ ID NO: 3149 - protein, 58 aa, Artificial Sequence
  Computer-generated peptide variant
RFKLLKKIIKRYCRLAPVRLKPAWAKRKCAKLENAQVACKTFAPKDRLSARHQQNRSS

SEQ ID NO: 3150 - protein, 33 aa, Artificial Sequence
  Computer-generated peptide variant
KYRLFRRFLKMLTKLTKFRDWRLADLWLEKHFL

SEQ ID NO: 3151 - protein, 28 aa, Artificial Sequence
  Computer-generated peptide variant
LYKLLSKLWKRWSRATKTLARMPAKKRG

SEQ ID NO: 3152 - protein, 24 aa, Artificial Sequence
  Computer-generated peptide variant
WLKLMTKLMKKIRQKDLARAKVIA

SEQ ID NO: 3153 - protein, 25 aa, Artificial Sequence
  Computer-generated peptide variant
WWRFYKKLLRRLNRVHMWAVKKLLY

SEQ ID NO: 3154 - protein, 27 aa, Artificial Sequence
  Computer-generated peptide variant
KYRIYKRYFKLMQKLLAQLRGWVADRA

SEQ ID NO: 3155 - protein, 45 aa, Artificial Sequence
  Computer-generated peptide variant
RLKFLKRYLKLLKRRYLRMKIIKRKRVIAAHCDAFCFSLECAAWQ

SEQ ID NO: 3156 - protein, 21 aa, Artificial Sequence
  Computer-generated peptide variant
RLKFFQKFLRKLNRASHLMTA

SEQ ID NO: 3157 - protein, 66 aa, Artificial Sequence
  Computer-generated peptide variant
MMRFLCKYMKRMKRDRRAHRKKALALAFMYAPKTAGGRHLWKNHFCKLDKLARWKALIIRTAACAP

SEQ ID NO: 3158 - protein, 98 aa, Artificial Sequence
  Computer-generated peptide variant
RLKILSKFWKRLCSARRDHRGKQRKLAHRRFQQSLLLRYLAAALRVKAGLRKQSKLFTKARHRTITRNKGYERTDHRIRRHLPLELWALIKIELLTTR

SEQ ID NO: 3159 - protein, 66 aa, Artificial Sequence
  Computer-generated peptide variant
KFKYWNKLLRYLHRKSRAAIFILRFQPNSMPWDLATLLRECAKAKSRRKALRLQQRALAVKWKNLH

SEQ ID NO: 3160 - protein, 48 aa, Artificial Sequence
  Computer-generated peptide variant
ILRLWTRYIKFMRRSLWKGLFALAAKRKLKKRYNCKCKLGSQAALKVV

SEQ ID NO: 3161 - protein, 20 aa, Artificial Sequence
  Computer-generated peptide variant
KWKLFKKFFRMLQSRLAALG

SEQ ID NO: 3162 - protein, 55 aa, Artificial Sequence
  Computer-generated peptide variant
KIRMLSRLIRKFRKAFHILRARDLSAKAMLAYALLQQRSARNIRHGFKMRWAKCG

SEQ ID NO: 3163 - protein, 54 aa, Artificial Sequence
  Computer-generated peptide variant
RIKLFNKLIKFLKKLGAKKLTRVKVALMIMLAQMEKCAPCTKKTWKAHAATRWR

SEQ ID NO: 3164 - protein, 29 aa, Artificial Sequence
  Computer-generated peptide variant
KLKILNRWLKWFKPYPAAKRVVASKWAPK

SEQ ID NO: 3165 - protein, 30 aa, Artificial Sequence
  Computer-generated peptide variant
MWKLYRRIMRKWHNLAMWDKALCRRLLIKK

SEQ ID NO: 3166 - protein, 36 aa, Artificial Sequence
  Computer-generated peptide variant
YLRIYKKFLKRIPRCGGTPCKALKARSARAILDKAH

SEQ ID NO: 3167 - protein, 47 aa, Artificial Sequence
  Computer-generated peptide variant
YLRIIQKLIKRFKKQLHYALRRYRLKRKSDVSRKIAEQNALLVAYKF

SEQ ID NO: 3168 - protein, 67 aa, Artificial Sequence
  Computer-generated peptide variant
KFKLIHKFFKKLHSEIMAKLKDFRALQARKLAPYKLALFMRLYKMLMKAWKTDRNRWYRKWLKTLAI

SEQ ID NO: 3169 - protein, 34 aa, Artificial Sequence
  Computer-generated peptide variant
KYKLLKRYFRKIPRYAEWAEHLAAGLKAAPQAKS

SEQ ID NO: 3170 - protein, 55 aa, Artificial Sequence
  Computer-generated peptide variant
RLRWLRRLLKWLKRKLCLEAHRWDAFRKKGLNKTWAACGRRPKRAHLAWPMAVRR

SEQ ID NO: 3171 - protein, 24 aa, Artificial Sequence
  Computer-generated peptide variant
FYKLFHRILKMLKRKYKATASFRA

SEQ ID NO: 3172 - protein, 29 aa, Artificial Sequence
  Computer-generated peptide variant
RLKLLRRLFRLLQRRKQIFWNRPWLSKPA

SEQ ID NO: 3173 - protein, 49 aa, Artificial Sequence
  Computer-generated peptide variant
KLRLFRRFWRLLRPCALRQGKVRQLAAYLVMCKIKPKMRARALNGREKF

SEQ ID NO: 3174 - protein, 50 aa, Artificial Sequence
  Computer-generated peptide variant
KIKLFHKMLRRMKKHLRKEERCCLLLTKAPHKRIRFFLLRCARHALYLQA

SEQ ID NO: 3175 - protein, 51 aa, Artificial Sequence
  Computer-generated peptide variant
KFRLFKRLLRFWRHATDCHCNQLLSRYKALLYTNKRKATRKRGLWRVKVLR

SEQ ID NO: 3176 - protein, 75 aa, Artificial Sequence
  Computer-generated peptide variant
RIRMMKKLWRRLKCHSFKAKLLGIRNVRACKMWGQRKLFAAVAKNTNWKKARLVQLKLLNRGAMKALFKRGDFPK

SEQ ID NO: 3177 - protein, 44 aa, Artificial Sequence
  Computer-generated peptide variant
KLRLLRRLLRLFRKRHLTKKKWFLKKYRRMLKLKKLALAPRNWL

SEQ ID NO: 3178 - protein, 50 aa, Artificial Sequence
  Computer-generated peptide variant
RLRILPRLLKRFRPILLDDYLGLTDVPRKGKARATTTLLKAKKLKLLCLL

SEQ ID NO: 3179 - protein, 59 aa, Artificial Sequence
  Computer-generated peptide variant
RFKLIQKLLKKMRKAKACKAACKVCSGLFAELKILGWYANLQLALVGLYKRLGKRMEFY

SEQ ID NO: 3180 - protein, 28 aa, Artificial Sequence
  Computer-generated peptide variant
LLKFWQRFMRYLRRMASRCKALKAEKYC

SEQ ID NO: 3181 - protein, 78 aa, Artificial Sequence
  Computer-generated peptide variant
RFRWLRRYIKLLRSDPEKLKKPAMWERCQCHLLRRDSLAKRPMISSALRGGCFPRTKRALGLHKAAAAYKKARKLARW

SEQ ID NO: 3182 - protein, 54 aa, Artificial Sequence
  Computer-generated peptide variant
LIRLLSRLLKRFRRRLRAPRMDNQLDDWLMGIQRERALMECANIYKLALAMFKA

SEQ ID NO: 3183 - protein, 89 aa, Artificial Sequence
  Computer-generated peptide variant
RLKLLHKLWKRFQRLYAFRALFANHLAYKNYRSSREEKNARARQLLLRTQAKDAADRDQRAGDAQLLQVFKKCARSESTLAAVHLTQRA

SEQ ID NO: 3184 - protein, 65 aa, Artificial Sequence
  Computer-generated peptide variant
LYRLFRKFLRLFNKVRLVRRRQRKFAAAKKNTAMLRLTLLNIQPIKFACLMISYELAAWCCAWAK

SEQ ID NO: 3185 - protein, 37 aa, Artificial Sequence
  Computer-generated peptide variant
KLRLFRKMYKLMRTFAKTSKKKIAHAAHAPAILCKGA

SEQ ID NO: 3186 - protein, 22 aa, Artificial Sequence
  Computer-generated peptide variant
KMRFLPKLYRKFKRLCLALMSQ

SEQ ID NO: 3187 - protein, 40 aa, Artificial Sequence
  Computer-generated peptide variant
LLRFYHRFLKLMRKRDKATEKANRAKDCFDQFIRMRLVRL

SEQ ID NO: 3188 - protein, 39 aa, Artificial Sequence
  Computer-generated peptide variant
KIKLFQRLLRLMRKKYACQLKHLEVARLRPAALATWRVL

SEQ ID NO: 3189 - protein, 31 aa, Artificial Sequence
  Computer-generated peptide variant
LMRWLKRFLKRIKNERYRQGITCMLKALKLL

SEQ ID NO: 3190 - protein, 45 aa, Artificial Sequence
  Computer-generated peptide variant
LYRIINRLMRRLNCHLKQIMCMLLLRRDARIKLLKANLKAHRWEY

SEQ ID NO: 3191 - protein, 60 aa, Artificial Sequence
  Computer-generated peptide variant
LFRFFKRWLKKFRTQIHARRLARCARRAYLKACEYCRLSLKALGAHAMSKELLSWYYLKR

SEQ ID NO: 3192 - protein, 33 aa, Artificial Sequence
  Computer-generated peptide variant
KYKLINKLMKRLRTLHLRGLACGAAVDPVARRC

SEQ ID NO: 3193 - protein, 82 aa, Artificial Sequence
  Computer-generated peptide variant
RLKFWQRMLRRLCKCYSKALKASYMRKFKKKWLAGKCFKLKKKNLKCRLSELRCCWHKKLTVRLLKHHRRALLSVALMKQAA

SEQ ID NO: 3194 - protein, 32 aa, Artificial Sequence
  Computer-generated peptide variant
RWKLLHRILKRLTSAEGSRFLRWPRYAPKKAQ

SEQ ID NO: 3195 - protein, 43 aa, Artificial Sequence
  Computer-generated peptide variant
KYKWLRKYLKFYKRLHRQAANRGLKLANREKGHLKPLRAWCLK

SEQ ID NO: 3196 - protein, 59 aa, Artificial Sequence
  Computer-generated peptide variant
RMRFFNKYWRKLRHADILRFLGREAKSAKALRLKKCACALLRKCLRLRDGGLTAELAET

SEQ ID NO: 3197 - protein, 67 aa, Artificial Sequence
  Computer-generated peptide variant
RWRLIKKLYKLWKKMPAQLKSRNFMCFLTRACRLLAVIMALLRLPLTAKRLRAKKAFAKENRKRYAA

SEQ ID NO: 3198 - protein, 21 aa, Artificial Sequence
  Computer-generated peptide variant
RLKLLQKLLKRLCNKGKALDV

SEQ ID NO: 3199 - protein, 38 aa, Artificial Sequence
  Computer-generated peptide variant
KLKLFRKFIRRWQRNTKTYAIRDLLAQDLTAWRERTRL

SEQ ID NO: 3200 - protein, 29 aa, Artificial Sequence
  Computer-generated peptide variant
RWRWYQRYLKLIRRAAAYRADYFHCRAMA

SEQ ID NO: 3201 - protein, 45 aa, Artificial Sequence
  Computer-generated peptide variant
LLKFYNRLLRIFTRDLRFKLDPFRKRPAAARKTLQGNLRHNKCAK

SEQ ID NO: 3202 - protein, 51 aa, Artificial Sequence
  Computer-generated peptide variant
RWRLYRKILRRYRRFRNAANSDFARLKMAQQRRLWLTTTAVARAGRTGAYK

SEQ ID NO: 3203 - protein, 31 aa, Artificial Sequence
  Computer-generated peptide variant
RLKIFRKFIKKLHRALYLSAELWGRRVLFNL

SEQ ID NO: 3204 - protein, 55 aa, Artificial Sequence
  Computer-generated peptide variant
RIRLWKRIYKLFTPCRKAGKDADKFWKKADAKRRCATTALPAAFEARKSLGRHHA

SEQ ID NO: 3205 - protein, 37 aa, Artificial Sequence
  Computer-generated peptide variant
LLRYWKKYLRKYKKYGRWRALRAMRKDQLHAALGDRM

SEQ ID NO: 3206 - protein, 65 aa, Artificial Sequence
  Computer-generated peptide variant
LMRLLRKYLKFMRKAAKRNRCPRIADATETKIAKAFIVRTAVRAPNLRACKLVCEMRAWLFASRN

SEQ ID NO: 3207 - protein, 34 aa, Artificial Sequence
  Computer-generated peptide variant
ILKMFHRWFRRIRPARLRGREYYVAAKLLCLGRK

SEQ ID NO: 3208 - protein, 24 aa, Artificial Sequence
  Computer-generated peptide variant
KFRFLKKLYKKLKKLAAAMAARCS

SEQ ID NO: 3209 - protein, 34 aa, Artificial Sequence
  Computer-generated peptide variant
KMRMYKKLWRKFTKRDEYLALRRLELTQNAMLLL

SEQ ID NO: 3210 - protein, 35 aa, Artificial Sequence
  Computer-generated peptide variant
LIRLYRRLIKKLQHMARLSCKGCSLAKLLFKIKDQ

SEQ ID NO: 3211 - protein, 46 aa, Artificial Sequence
  Computer-generated peptide variant
FLRLLRKLFKKLKREAADFLCQIREKARSYILLSAVLRHLEYANCG

SEQ ID NO: 3212 - protein, 72 aa, Artificial Sequence
  Computer-generated peptide variant
FWRLYKRIMRFLQPADAVKQRYLDWYTLRAKARFLFKKRRVLIAGKKRLDAPLRGKRQMRLIHTKAQLLHAR

SEQ ID NO: 3213 - protein, 31 aa, Artificial Sequence
  Computer-generated peptide variant
KWRMLQKLWRKWKRYRWTATAANRFMHAKAA

SEQ ID NO: 3214 - protein, 55 aa, Artificial Sequence
  Computer-generated peptide variant
RLRFMSRYLRLLKRAARVLLWHYRLVKAKRFAAPASANFPLERCMVFQGLVLKDR

SEQ ID NO: 3215 - protein, 38 aa, Artificial Sequence
  Computer-generated peptide variant
LLRLICKLFKRFRRNGVMVKRNDAARALLKWRYMDKGT

SEQ ID NO: 3216 - protein, 32 aa, Artificial Sequence
  Computer-generated peptide variant
RLRLLRRFIRLWRKDAGTKGATLQACLRTHLR

SEQ ID NO: 3217 - protein, 21 aa, Artificial Sequence
  Computer-generated peptide variant
FWRLLKRLLRRLCSKGAHAKC

SEQ ID NO: 3218 - protein, 33 aa, Artificial Sequence
  Computer-generated peptide variant
RLKWMKKFLRFLKRLFQAWLLCKSKKAMNRDQA

SEQ ID NO: 3219 - protein, 66 aa, Artificial Sequence
  Computer-generated peptide variant
KFKYWSKMIRLWRQAPRLARMNLGKLLKMAAKLPSDPARMKDRRYFEACRNKRYATLVEKRRKLAW

SEQ ID NO: 3220 - protein, 90 aa, Artificial Sequence
  Computer-generated peptide variant
LYKFWRRFLRRMKCLWTKKILQKVLALRLLANPKKLWRKLKALMRSLHWGEMTKPKNALALYRVPLAKSKLSRADLLTATKALRWKRISL

SEQ ID NO: 3221 - protein, 69 aa, Artificial Sequence
  Computer-generated peptide variant
KFKYWRRFWRRMRKKAATCAFDGMLKMRKKLTTAELIRERAFALARQRKRFRNKEADSLGWKTLWAALL

SEQ ID NO: 3222 - protein, 36 aa, Artificial Sequence
  Computer-generated peptide variant
YFRLMRKFYKKLKQAIFKPLALWKNCPAAVWSLRRR

SEQ ID NO: 3223 - protein, 52 aa, Artificial Sequence
  Computer-generated peptide variant
LLRFFSRMYKKLKKDAMLLATRRRKAIRPYHAPNEKNKLQSFLYCLAKLRPR

SEQ ID NO: 3224 - protein, 26 aa, Artificial Sequence
  Computer-generated peptide variant
LWKFLRRFLKWLNTRLEAKMERIIAA

SEQ ID NO: 3225 - protein, 56 aa, Artificial Sequence
  Computer-generated peptide variant
ILKYFKRFLKFLKQCWAKQERPAASADFCKARLFMCILSASKAAHNRRDRALLKVL

SEQ ID NO: 3226 - protein, 27 aa, Artificial Sequence
  Computer-generated peptide variant
KLKFLRKLLRLLRKTCYAGDRELRCGA

SEQ ID NO: 3227 - protein, 34 aa, Artificial Sequence
  Computer-generated peptide variant
RMKLYRRILRLLPRVLARATIHKCKAGAAKGYML

SEQ ID NO: 3228 - protein, 34 aa, Artificial Sequence
  Computer-generated peptide variant
KFKFYKKLFRKITKLIQKADQVGRLAIMARARAW

SEQ ID NO: 3229 - protein, 44 aa, Artificial Sequence
  Computer-generated peptide variant
KWKILHRLLKLYKREIQRWALWKKLIRQCYARRKHHKAMQFLVA

SEQ ID NO: 3230 - protein, 30 aa, Artificial Sequence
  Computer-generated peptide variant
FFKLLKRMYKLFTKLNKKSGARNAHLVDAR

SEQ ID NO: 3231 - protein, 44 aa, Artificial Sequence
  Computer-generated peptide variant
ILRFYKRWFKLYNKVELVKTRLNKYATCRAFRLRRACMLRAFLR

SEQ ID NO: 3232 - protein, 63 aa, Artificial Sequence
  Computer-generated peptide variant
LLKWFQKLFRFFKKTKLRKARILQRARNAHNEKALEKWYKHKKRSKLAKLARDCLYWADKRMN

SEQ ID NO: 3233 - protein, 69 aa, Artificial Sequence
  Computer-generated peptide variant
KWRFLNRYIKFWRKGKRWRREKRLAALKRLLHVRLGGDLKLAEMLGQCASLAAKLSRLTAADDKGHGVY

SEQ ID NO: 3234 - protein, 40 aa, Artificial Sequence
  Computer-generated peptide variant
KLKLFTKWYKLLKCKFSHWRPVHFGKLAIRGQLKLLAPLR

SEQ ID NO: 3235 - protein, 39 aa, Artificial Sequence
  Computer-generated peptide variant
RIKMFKKILKKYQKEPVKTLLRAKCLVELVAHRYLRAMA

SEQ ID NO: 3236 - protein, 26 aa, Artificial Sequence
  Computer-generated peptide variant
ILKLIKRWLKKLSQLRAKGGQQQLFL

SEQ ID NO: 3237 - protein, 26 aa, Artificial Sequence
  Computer-generated peptide variant
RLRILSRFFKLLKRKRAALWEMSAWP

SEQ ID NO: 3238 - protein, 42 aa, Artificial Sequence
  Computer-generated peptide variant
KIRFLKRFLKMMKKRVAYAAASIEFRWRKCQPLNALLTLAKS

SEQ ID NO: 3239 - protein, 45 aa, Artificial Sequence
  Computer-generated peptide variant
RFKMMCRMLKWMKRLLLAALCWKKCQHKVNLKRIGGLLLKREKSW

SEQ ID NO: 3240 - protein, 87 aa, Artificial Sequence
  Computer-generated peptide variant
YFRWIKRYWRRFCSLTLLLRAKDCAVLSLRAMYALRPHKVPKVWGTECADVKRRNLYRRARMKDRQKFLARAAARAPARIDALPLVK

SEQ ID NO: 3241 - protein, 30 aa, Artificial Sequence
  Computer-generated peptide variant
KFKYLRRLMKLLKCELHLGCKRRRTSFAAN

SEQ ID NO: 3242 - protein, 21 aa, Artificial Sequence
  Computer-generated peptide variant
RMRLYKKLWKRWRTAEATYIL

SEQ ID NO: 3243 - protein, 30 aa, Artificial Sequence
  Computer-generated peptide variant
IYKLLRKLLRRIRRPDMKLDESPMLLKNRT

SEQ ID NO: 3244 - protein, 67 aa, Artificial Sequence
  Computer-generated peptide variant
RWKLLPRLLKRYKKKWWAAACPFLADRTAKLSLWKLFTMLRHNRLKQKKRLCNSHKLSWRRAEFLKG

SEQ ID NO: 3245 - protein, 60 aa, Artificial Sequence
  Computer-generated peptide variant
LLKFFKKMWKIMRNGNKRLAIKALTWFTRWLLTDMGWVLKGAAHARAMAVALRKKLLFRM

SEQ ID NO: 3246 - protein, 30 aa, Artificial Sequence
  Computer-generated peptide variant
LLKLLKKLLKIWKQLIRLKHKWNYRKAAKG

SEQ ID NO: 3247 - protein, 59 aa, Artificial Sequence
  Computer-generated peptide variant
KLKWYQKILKKLRKFPKAKLTEYKVGQYARMIQRLKAIAKAARLKPKALAGCRKLRRFW

SEQ ID NO: 3248 - protein, 44 aa, Artificial Sequence
  Computer-generated peptide variant
FLRFFKKFMRFLKKLMLAPKFHAKARKIAGKADALYKRKLKRDA

SEQ ID NO: 3249 - protein, 27 aa, Artificial Sequence
  Computer-generated peptide variant
FYKIYRKYLRLFKKLPKSSLLNARHQL

SEQ ID NO: 3250 - protein, 60 aa, Artificial Sequence
  Computer-generated peptide variant
KMKLLCRLLRFIQKYMSAVFAKSLMARVAMYCTHAASLARLAKKKLKDEQACKRMRTKLK

SEQ ID NO: 3251 - protein, 62 aa, Artificial Sequence
  Computer-generated peptide variant
RLRMLRRLFRLLSPIKIREAYALAYLAAQAKALLSKWRLWRKKQKGRRADYCRYLTKIAHAV

SEQ ID NO: 3252 - protein, 80 aa, Artificial Sequence
  Computer-generated peptide variant
LLKILKRMFKLIRPLLQGKHKLGDLLLLAAKYILADKAVSWRDLPLPLIMKKSNRKLDWLFLNFINGYGKKKRHLKRADL

SEQ ID NO: 3253 - protein, 48 aa, Artificial Sequence
  Computer-generated peptide variant
RLKYLRRWLRRMNKTRAGRVQREKIRAMHPAGAVATLRAYSLRCADLN

SEQ ID NO: 3254 - protein, 39 aa, Artificial Sequence
  Computer-generated peptide variant
RFRILRKFYKLYKHEAALVCAALRAARIYYKLKRQVCRG

SEQ ID NO: 3255 - protein, 38 aa, Artificial Sequence
  Computer-generated peptide variant
WMRFLHRFLKRIRKHMAACRKALGWYKAKAQLIKKPTE

SEQ ID NO: 3256 - protein, 29 aa, Artificial Sequence
  Computer-generated peptide variant
KLKFYRKWLKKYRCAKRENALSMAGGGLF

SEQ ID NO: 3257 - protein, 61 aa, Artificial Sequence
  Computer-generated peptide variant
RMRWFKKFLKIMKKKQPEAFLLLAKVLCHRRANKMAFPKLKTSASKKLGYRFARLAERRLY

SEQ ID NO: 3258 - protein, 69 aa, Artificial Sequence
  Computer-generated peptide variant
KMKFMTRWIRRLRRFNRPRAEKLCLKTHTACQILSDPRQFKALTHRLIHYKAYKLALLLRARLLRLGKT

SEQ ID NO: 3259 - protein, 32 aa, Artificial Sequence
  Computer-generated peptide variant
RMKYLSRMFRKISCRAAPALPASELAKAIARQ

SEQ ID NO: 3260 - protein, 54 aa, Artificial Sequence
  Computer-generated peptide variant
KIRFFCKLLRKYKKIIKWIRMRQALNKDANARAPHEKRLCAGAARRTVKAIMLS

SEQ ID NO: 3261 - protein, 32 aa, Artificial Sequence
  Computer-generated peptide variant
KFKMLTKLIKKLKKALNKPRDLLLKPGCKALR

SEQ ID NO: 3262 - protein, 32 aa, Artificial Sequence
  Computer-generated peptide variant
FLRLFRRILKILRNLDLKGLSPRDRKALKKNL

SEQ ID NO: 3263 - protein, 45 aa, Artificial Sequence
  Computer-generated peptide variant
YWKILQKLLKKLRRDCQLRTQGRARWLRKRKACACAWRALLAAPN

SEQ ID NO: 3264 - protein, 80 aa, Artificial Sequence
  Computer-generated peptide variant
WFKMMKKLLKYLQRSFKQVLDRSKLQCALKRDSKLKDLQLACASAKQKLAKRAKNQCSEANLMPARMKKAMYDLKWRFER

SEQ ID NO: 3265 - protein, 20 aa, Artificial Sequence
  Computer-generated peptide variant
KYKYMTRLIRLYRKAATNKL

SEQ ID NO: 3266 - protein, 28 aa, Artificial Sequence
  Computer-generated peptide variant
KYRFMKKLLKLLSPRFAKLLKLTLCDPR

SEQ ID NO: 3267 - protein, 65 aa, Artificial Sequence
  Computer-generated peptide variant
KFKMFQRYLRKFKRRKDWTCKLTLRAAQALKANLKKFCYWPLWAKLFQLLKSDKNALASERKCVR

SEQ ID NO: 3268 - protein, 43 aa, Artificial Sequence
  Computer-generated peptide variant
IMRFIRKFLKRYRKFALAAEDKALAKKRYLVYKNIRHTQAVAQ

SEQ ID NO: 3269 - protein, 34 aa, Artificial Sequence
  Computer-generated peptide variant
KLRLFRRLIRRLQRWLARVSLWAIMHHLALARRR

SEQ ID NO: 3270 - protein, 54 aa, Artificial Sequence
  Computer-generated peptide variant
LWRILKRLLRKLRRAKARAHDRRFRQWIYAVFQSTRWRVFWLQAPLKHAGFLHA

SEQ ID NO: 3271 - protein, 63 aa, Artificial Sequence
  Computer-generated peptide variant
MIKYLPKYLRKYNPARTQLRWEWISCCNRACAALLKLAMSYLKWALLRWREWYLRKKLALIRR

SEQ ID NO: 3272 - protein, 22 aa, Artificial Sequence
  Computer-generated peptide variant
LLRFLSKLLKYIHKMYRLKAKM

SEQ ID NO: 3273 - protein, 52 aa, Artificial Sequence
  Computer-generated peptide variant
LLRWMKRWMRILRRLYWCRNRYKRKKRGKKAVEAPQKEAFGDNTLALAATHR

SEQ ID NO: 3274 - protein, 26 aa, Artificial Sequence
  Computer-generated peptide variant
LYKWLQKFLRKIKKGSDLFLAKAPLT

SEQ ID NO: 3275 - protein, 24 aa, Artificial Sequence
  Computer-generated peptide variant
RLKLFPRWLRKMKKRRLALLPAWP

SEQ ID NO: 3276 - protein, 20 aa, Artificial Sequence
  Computer-generated peptide variant
RLKFLKKLLRMMNKDAKCAS

SEQ ID NO: 3277 - protein, 28 aa, Artificial Sequence
  Computer-generated peptide variant
KYKMLKKFYRRYRCAARILFRAAELMWF

SEQ ID NO: 3278 - protein, 36 aa, Artificial Sequence
  Computer-generated peptide variant
RFKLFRRIIKLFPNYAAKHAKAKFCNADDKLLSRKL

SEQ ID NO: 3279 - protein, 50 aa, Artificial Sequence
  Computer-generated peptide variant
IWRLIKRLLKRFTRLWHNQYACCASSFKLTAYIAACLRLWDAAHLKKKKK

SEQ ID NO: 3280 - protein, 37 aa, Artificial Sequence
  Computer-generated peptide variant
KMKYYNRLMKLMTTGALWRKIFACLLRAQRRLLYRRL

SEQ ID NO: 3281 - protein, 78 aa, Artificial Sequence
  Computer-generated peptide variant
KFRMIKRLLKFLKRHDKALKFHRLNHNAPVERWAALTLSKMSPGTGLLKGHKARGLVTLELKVLRLRCLWWKAKRLAL

SEQ ID NO: 3282 - protein, 99 aa, Artificial Sequence
  Computer-generated peptide variant
RYKFLKRLLRLIRRLLLARKWVLRVSKKVEVATAKHALCRIVLLKNMCKKRCLALMDSQKARLCSLPLGRKFKAVPDSPKLKRRAGHTEGIRDGTALGQ

SEQ ID NO: 3283 - protein, 25 aa, Artificial Sequence
  Computer-generated peptide variant
FLKILRKYLKRYKKYECLWKKLAAL

SEQ ID NO: 3284 - protein, 100 aa, Artificial Sequence
  Computer-generated peptide variant
LIKMLRKLYKKLRRNKQKNIALRTHRHALRAHPPLLKERKGARWRLRWMLSMLPLMFVRLNAWWDWSKKRDWALRKYLKWMNAMLMSAKKKNWHQKCAKP

SEQ ID NO: 3285 - protein, 38 aa, Artificial Sequence
  Computer-generated peptide variant
KLRLMCRLFKRLTCHLALSSKALKTLRDRERKLTYDTK

SEQ ID NO: 3286 - protein, 50 aa, Artificial Sequence
  Computer-generated peptide variant
KLRYWRKFLKFLRNKWAHKRTRARCLALLAMDNFKAKRRHPPYLLLYLYM

SEQ ID NO: 3287 - protein, 88 aa, Artificial Sequence
  Computer-generated peptide variant
RMKFFNRFLRKYHRTNIDRTRLVVARLQNLAIGYLLPKYFKLRLNRRPERWWRKLARVQSLLLAGRKAIVMALAGKLRLRVLVNRIKL

SEQ ID NO: 3288 - protein, 22 aa, Artificial Sequence
  Computer-generated peptide variant
KLKFFRRLYKLWNRCAQRLLML

SEQ ID NO: 3289 - protein, 22 aa, Artificial Sequence
  Computer-generated peptide variant
KLKIFQRLFRLFRPRFRVYALA

SEQ ID NO: 3290 - protein, 86 aa, Artificial Sequence
  Computer-generated peptide variant
KLKLFPRLYKFLRKTKAKYELLERRCAALDWSHKEWRKRALQSKAVYDLNNADLRLAIRLRALFGSRCGAKLCLYRRTETCCTLRL

SEQ ID NO: 3291 - protein, 23 aa, Artificial Sequence
  Computer-generated peptide variant
FLRLLKKLYRKFKREKLCLCNKL

SEQ ID NO: 3292 - protein, 51 aa, Artificial Sequence
  Computer-generated peptide variant
LYRWYKKLIRKIKSFARKLGLALCREWAQFGYALYRRLRRKIRAYYVRNLL

SEQ ID NO: 3293 - protein, 74 aa, Artificial Sequence
  Computer-generated peptide variant
FLKIFNKLWKFLKRLLKRDDPDEYMLRLYFAALVFAKKNGLKKHTLTRGDQFTVKAKARVALYRMRAAALELAL

SEQ ID NO: 3294 - protein, 87 aa, Artificial Sequence
  Computer-generated peptide variant
FLKYLKRLLRLLKTRKLKKTGCADHRCAAKYNRIATRGATKSDAKRARGQKTSMCKLCLYQRALEYITRLLQCKARKLLNLLAALAK

SEQ ID NO: 3295 - protein, 32 aa, Artificial Sequence
  Computer-generated peptide variant
KWKLFRRFLRRIKNCLRKQSYKLQLVNRLAAM

SEQ ID NO: 3296 - protein, 97 aa, Artificial Sequence
  Computer-generated peptide variant
KYKMLNRLYRRLRTAGTKHKIGLKLACKVDKWRNAACLLHFILKYFHKGKFALMASQAKRQIKLKKLKRKRPKVALWNHERDAAKKLKLKSMRMFWR

SEQ ID NO: 3297 - protein, 63 aa, Artificial Sequence
  Computer-generated peptide variant
KLRYFCKYYRRLPTRKKQIRAMPAFPDRRRCLAILGVPNKAWRAKLQKKAAGKLERHKASQEA

SEQ ID NO: 3298 - protein, 38 aa, Artificial Sequence
  Computer-generated peptide variant
RIRFYKKLLKRLRNRAIHKHFLKKQLAATAALHKNCYK

SEQ ID NO: 3299 - protein, 55 aa, Artificial Sequence
  Computer-generated peptide variant
ILRLMKRYFKFYKRTRRQRDTPLKADAAKAWRLALFLKLRGMYQRKIKGRPCGAL

SEQ ID NO: 3300 - protein, 46 aa, Artificial Sequence
  Computer-generated peptide variant
LWRIMKKMMRKYRNQSRAALVAGSEPAHRKAYLFLARLRLRKTLCM

SEQ ID NO: 3301 - protein, 41 aa, Artificial Sequence
  Computer-generated peptide variant
RLRLFTRWYKKWRKKNLAKVKILVLDQAAKYRAGLRRIAGK

SEQ ID NO: 3302 - protein, 36 aa, Artificial Sequence
  Computer-generated peptide variant
RLKFLTKLFRFFSCIAAARCEAKDRKLRKALAWAKA

SEQ ID NO: 3303 - protein, 43 aa, Artificial Sequence
  Computer-generated peptide variant
FLKLWPKLIKFLKTLPSMANRGEAKAKYRLSCRGLIAKEKLLS

SEQ ID NO: 3304 - protein, 45 aa, Artificial Sequence
  Computer-generated peptide variant
RMRWLPRLWKKLRKWLLCMVRPDTLTWLHLAGIASALKCATRLRK

SEQ ID NO: 3305 - protein, 60 aa, Artificial Sequence
  Computer-generated peptide variant
FFRLLCRMLKKIQSKNRSLYLRARSKILLQAALAIVGKYKMIKAPKPIKKGRLDIQPRKK

SEQ ID NO: 3306 - protein, 22 aa, Artificial Sequence
  Computer-generated peptide variant
LYKLLRKYMKWLPTIHLRKKYL

SEQ ID NO: 3307 - protein, 72 aa, Artificial Sequence
  Computer-generated peptide variant
KLKYLRKLFRIIHRGRTTRLLLRLDRKHLAARCCLRWKWFSRIHTFRAKAGMKLGELGLIILCLRNARIGFR

SEQ ID NO: 3308 - protein, 22 aa, Artificial Sequence
  Computer-generated peptide variant
LLRLYSKLIRYIRQKLRPKVAD

SEQ ID NO: 3309 - protein, 77 aa, Artificial Sequence
  Computer-generated peptide variant
RYRFLKKFIKLLQKYALRDSRKKHLFLALGKCVLKLLQMHARDHAKHKTSHAARAHELYKARDATRAIFELRPARLA

SEQ ID NO: 3310 - protein, 59 aa, Artificial Sequence
  Computer-generated peptide variant
RMKWLSRLFKLIKTRLRPLAWKMRRRLLKAHLQRDHRRRFFRFIRLAIAKAGVKTPYHA

SEQ ID NO: 3311 - protein, 53 aa, Artificial Sequence
  Computer-generated peptide variant
KLRFFQKFFKKMKKSAMAKAHLLANKIKAIAKARFYQLWLLHNKKKYALAGRK

SEQ ID NO: 3312 - protein, 74 aa, Artificial Sequence
  Computer-generated peptide variant
LWRFMKRLLRRWKKAQLLKLPWRARKRLGRGKMHRVRARLALPARKFLRDLGLRDLAKEKQAHKASREKKPKQH

SEQ ID NO: 3313 - protein, 65 aa, Artificial Sequence
  Computer-generated peptide variant
LYRLYKKFLKRMNRLNKLAILRGMHQLLRVNRGGKDRVRLHRAWCLVRAIAALRRRFLLYLWKRA

SEQ ID NO: 3314 - protein, 54 aa, Artificial Sequence
  Computer-generated peptide variant
RLKLLKRYLRRLKRYLTQNTTMRANFRVKMLLVIRKANGHAHLLKKLDRKKRYW

SEQ ID NO: 3315 - protein, 57 aa, Artificial Sequence
  Computer-generated peptide variant
RLRIMKRLYKWFKCFPAHRLMNRQGLRKRWKLLHFRLKRAHLPWLLVENKEATAAAR

SEQ ID NO: 3316 - protein, 54 aa, Artificial Sequence
  Computer-generated peptide variant
FLRFWKRYIRKLNQPGHRIKSWARKASYSKRGRKLARHPAGKKAAKLCHGAARA

SEQ ID NO: 3317 - protein, 25 aa, Artificial Sequence
  Computer-generated peptide variant
KFRMLRKWLKFLRQAAQKANPLWRF

SEQ ID NO: 3318 - protein, 40 aa, Artificial Sequence
  Computer-generated peptide variant
WLKFLPRWIKLITPFLAHKHGRRLQLRKRLATRAMKASWR

SEQ ID NO: 3319 - protein, 90 aa, Artificial Sequence
  Computer-generated peptide variant
KLRYLKKLIKRLSKAHRRAQPIRAVRAWYHSKHAVWRGNARKSKCDLMRKLRKTKATLPILIKRSNRFKMIHKPVLRLLGLKTIAAKTLQ

SEQ ID NO: 3320 - protein, 34 aa, Artificial Sequence
  Computer-generated peptide variant
KWKFWKKWIKWLQTAQARLALAGLKAKNKIKAVC

SEQ ID NO: 3321 - protein, 54 aa, Artificial Sequence
  Computer-generated peptide variant
RLKLYPKFYRLLRRLLKLAHRKALTLPPTDHWKHKAKWLFLLNFWRRAMWLKIA

SEQ ID NO: 3322 - protein, 40 aa, Artificial Sequence
  Computer-generated peptide variant
KMKYMRRMFKKLRRANDKNARLKILYGCLDKQNLKLWAII

SEQ ID NO: 3323 - protein, 49 aa, Artificial Sequence
  Computer-generated peptide variant
KFKLLRRFFRKMRTVPLTAARVIAKYKPAFFHRTYAWKKKARRLLLARL

SEQ ID NO: 3324 - protein, 26 aa, Artificial Sequence
  Computer-generated peptide variant
YLRWYRKLLKRLHKLLNEFDRGKACR

SEQ ID NO: 3325 - protein, 24 aa, Artificial Sequence
  Computer-generated peptide variant
LFKLIRKWWRRLKRDLAEKLMRLY

SEQ ID NO: 3326 - protein, 35 aa, Artificial Sequence
  Computer-generated peptide variant
FLKLLKRLYKRIHKLGGKWQLCSKLVGFLMKIAKA

SEQ ID NO: 3327 - protein, 27 aa, Artificial Sequence
  Computer-generated peptide variant
KYRLLCRLLKLWKCHRAMKWDKCSATK

SEQ ID NO: 3328 - protein, 75 aa, Artificial Sequence
  Computer-generated peptide variant
RFKIMKKYWKRLRRAKNRSMMSMKNLRKLAAAELFRYAMVRAHETLRAKAAFQCRVARAQYARAHNMYLGKGTRA

SEQ ID NO: 3329 - protein, 69 aa, Artificial Sequence
  Computer-generated peptide variant
KYRYFRRLLKRWNRATDKAARWRFTWCIKAKHVAWLKAWLGVLALFACKERRLLNDMDCAEYLYRRWKA

SEQ ID NO: 3330 - protein, 38 aa, Artificial Sequence
  Computer-generated peptide variant
KIRFYRKILRLMPKCAATCELLKPRAKVAVQALRKRNC

SEQ ID NO: 3331 - protein, 22 aa, Artificial Sequence
  Computer-generated peptide variant
FLRFLKRMLRFLCKTWKANPAL

SEQ ID NO: 3332 - protein, 20 aa, Artificial Sequence
  Computer-generated peptide variant
WIRFLCRIYKLLRTALIDLK

SEQ ID NO: 3333 - protein, 74 aa, Artificial Sequence
  Computer-generated peptide variant
RFRMLNKFLRRFHPALTDRKAKKMCFAAPTMHRRRLAARLKENFVKYDLKHRLQGRKELNVACLAKTRKVAMNR

SEQ ID NO: 3334 - protein, 51 aa, Artificial Sequence
  Computer-generated peptide variant
KMKLLRKLFRKFSRLAALQIRPRLLRWWNKWRPLWALGLPDPKMHRIRNYR

SEQ ID NO: 3335 - protein, 22 aa, Artificial Sequence
  Computer-generated peptide variant
KWKIYHKILKRLRNALWIVLLK

SEQ ID NO: 3336 - protein, 66 aa, Artificial Sequence
  Computer-generated peptide variant
RFRIFQRLLRLLHTAGKSVQALPRTLLRLTGYALAKKRQPQRLKLRMAHARLMVAVLIKLKNFKYE

SEQ ID NO: 3337 - protein, 67 aa, Artificial Sequence
  Computer-generated peptide variant
KYKLFKKFFKKLNRRAQVRAKLKKIYLSALAERQMLQRNQWAALLAYRLKKEHSKKYFPPRDMTVKK

SEQ ID NO: 3338 - protein, 36 aa, Artificial Sequence
  Computer-generated peptide variant
RIKLLKKLLKRLRPIAKYKGLWPADWLRDAQLIADA

SEQ ID NO: 3339 - protein, 50 aa, Artificial Sequence
  Computer-generated peptide variant
RMKWYQKYLKFLKREILKKHRLIMKRAAWAAAAIRWNKAWKILWCLNRDR

SEQ ID NO: 3340 - protein, 49 aa, Artificial Sequence
  Computer-generated peptide variant
KWKILRRLLKKWKNKAPAAGPHATWYHYAKQYLRWRWRKADWKKWGHAL

SEQ ID NO: 3341 - protein, 56 aa, Artificial Sequence
  Computer-generated peptide variant
FWRMFQKLLRLLPKRAARVQLAHRKDMATKKMQANKLMRAGRKFTLKDLLRIKIYM

SEQ ID NO: 3342 - protein, 42 aa, Artificial Sequence
  Computer-generated peptide variant
KIRFIKKMYKKLNCLVAAAAARRARAAADARMCPNKAKERRL

SEQ ID NO: 3343 - protein, 34 aa, Artificial Sequence
  Computer-generated peptide variant
RLRMLPRWFKKLKKGKTQLITRAKLKAANAIRCC

SEQ ID NO: 3344 - protein, 33 aa, Artificial Sequence
  Computer-generated peptide variant
KWKYYPRFLKYMRKIRAGAPKLRIRTNLLARSA

SEQ ID NO: 3345 - protein, 67 aa, Artificial Sequence
  Computer-generated peptide variant
LFRLIRKFMRKYRRVEDRFFLRKRLHLWLLLRWVDWLSKRVLASMMGKIDRALFGRAEKYRMLLLAH

SEQ ID NO: 3346 - protein, 21 aa, Artificial Sequence
  Computer-generated peptide variant
RWRYMKKLLKFLKTAWTCKAN

SEQ ID NO: 3347 - protein, 32 aa, Artificial Sequence
  Computer-generated peptide variant
KLKFMRKYLRWLKRANAYLKIPSAKCKLFTEL

SEQ ID NO: 3348 - protein, 54 aa, Artificial Sequence
  Computer-generated peptide variant
KWKLLNKMFRIFKKALAARKLLLAGGDQKYLTPARLVLIQKSCHQNKLHAARDR

SEQ ID NO: 3349 - protein, 59 aa, Artificial Sequence
  Computer-generated peptide variant
KFKLFKKFIRLMKKAARETWNHAAHATRFLRYAYLKLKLKAISLKKVHAATRAKKWDIQ

SEQ ID NO: 3350 - protein, 31 aa, Artificial Sequence
  Computer-generated peptide variant
LYKILRRLLKLLRKKIMFRGHGFGVKAICLR

SEQ ID NO: 3351 - protein, 40 aa, Artificial Sequence
  Computer-generated peptide variant
YWKWLHRFLKRIRTLNKRVARERLHKLYLQLPRFLFKMDA

SEQ ID NO: 3352 - protein, 22 aa, Artificial Sequence
  Computer-generated peptide variant
KLKFMRKFIRMFRQKAAAWLWA

SEQ ID NO: 3353 - protein, 69 aa, Artificial Sequence
  Computer-generated peptide variant
RLKWLTKLLKRYKKATTKQMRRKYYRAFQRKERACRCLTQQDTLNLPCPWARKAILQKAAAVRKHSCYR

SEQ ID NO: 3354 - protein, 23 aa, Artificial Sequence
  Computer-generated peptide variant
RLRFIHKWFRRLRNGLKAFALLR

SEQ ID NO: 3355 - protein, 41 aa, Artificial Sequence
  Computer-generated peptide variant
RFKLLNKLYRRWRRAKLMGLRLLLRLHYLFHQKNLKLMRRL

SEQ ID NO: 3356 - protein, 72 aa, Artificial Sequence
  Computer-generated peptide variant
KLRFFRKFIRMLPKTKDRRLYAPAERLTLHLRRNLRARRMIMKLKLGALCIPGCTLKLAIRCRRKKASNRDW

SEQ ID NO: 3357 - protein, 47 aa, Artificial Sequence
  Computer-generated peptide variant
FFRLIRKYMRYLRSQRSQYNAARGRLAPLLKCLKWFTAVVLTALRLA

SEQ ID NO: 3358 - protein, 44 aa, Artificial Sequence
  Computer-generated peptide variant
RLKMLRKFFRYLKRKLKLAIRGGERNDHAAKLDAPVQCNATYRL

SEQ ID NO: 3359 - protein, 40 aa, Artificial Sequence
  Computer-generated peptide variant
LIRLIKRLLKRWSSSRLLCKRTTVAVSQAFRLLKRKKDPA

SEQ ID NO: 3360 - protein, 21 aa, Artificial Sequence
  Computer-generated peptide variant
LWKMLRRLLRKLNKILAEKRR

SEQ ID NO: 3361 - protein, 36 aa, Artificial Sequence
  Computer-generated peptide variant
LMKLLKRIFRKWRRQVCWAAAGLKSCMKAHRADGAL

SEQ ID NO: 3362 - protein, 53 aa, Artificial Sequence
  Computer-generated peptide variant
KFKYIKKLWKRWKKTARTKKSLFKIGALFTLKYGLAMTAKKNRKLALASGFAW

SEQ ID NO: 3363 - protein, 44 aa, Artificial Sequence
  Computer-generated peptide variant
WLRLWPKLLKRLKKCWRLRLAAKMHRKFACKIERMHSPKALFSY

SEQ ID NO: 3364 - protein, 38 aa, Artificial Sequence
  Computer-generated peptide variant
KFKLIKRLLRRYRCALQDLLDKWAKRIRYAYCFQEMRQ

SEQ ID NO: 3365 - protein, 97 aa, Artificial Sequence
  Computer-generated peptide variant
RWKLFKKLYRKFPKLIARASKESPDAETVAAFQLATVMFKQAADWALKPNKNLLRTRLAAAANWCLKRNNHFALYNLKKDRKRRSKAPLQNKAKRSN

SEQ ID NO: 3366 - protein, 37 aa, Artificial Sequence
  Computer-generated peptide variant
KLRILKKMMKWLQTLAPIPSKALRKSLKVKRLKLDNF

SEQ ID NO: 3367 - protein, 25 aa, Artificial Sequence
  Computer-generated peptide variant
KFRLFTRFLKFLRKAPDAKNRQGGA

SEQ ID NO: 3368 - protein, 35 aa, Artificial Sequence
  Computer-generated peptide variant
RWKLLKRLFKRLHKFATAAAVLRWMRLKPRLWWTV

SEQ ID NO: 3369 - protein, 83 aa, Artificial Sequence
  Computer-generated peptide variant
RFKFLKKLWRFYKTETSAHAVAAMCMLYLRKQKQLWFAKHDLLLLLSKPFFLGLWDLAMLLYARKWKRLGKVAALQRAKKMNF

SEQ ID NO: 3370 - protein, 32 aa, Artificial Sequence
  Computer-generated peptide variant
RYRWFRRFLKKFRRAMLNKFRVLSVARTLALE

SEQ ID NO: 3371 - protein, 32 aa, Artificial Sequence
  Computer-generated peptide variant
IFKYMKKWLKLITHKYLKDSAGRALKAARVKA

SEQ ID NO: 3372 - protein, 56 aa, Artificial Sequence
  Computer-generated peptide variant
KLRYFRKIFKLIRKPQALALKAAKKYLDKVQRRAMWRQTLRAFWGVKAFANTKKCA

SEQ ID NO: 3373 - protein, 69 aa, Artificial Sequence
  Computer-generated peptide variant
LLKLLRRWWKWMRRIARHLGCVCLLGRKNQKRVQLPYNYVKMTKAAALSMRKLRTPTAKVLAEDPAARA

SEQ ID NO: 3374 - protein, 27 aa, Artificial Sequence
  Computer-generated peptide variant
RYRLYNRFIRLLKKKFSQHARAELAQM

SEQ ID NO: 3375 - protein, 66 aa, Artificial Sequence
  Computer-generated peptide variant
KMRFFQRFWKRYRKLLPAYIKRLWATKGDLVILNRRLRERRRLAQLHTASLSLASKIRPKSFRAFA

SEQ ID NO: 3376 - protein, 34 aa, Artificial Sequence
  Computer-generated peptide variant
RFRIFRKWLKILKKCAVLQGKFIYTRDAALLRRG

SEQ ID NO: 3377 - protein, 72 aa, Artificial Sequence
  Computer-generated peptide variant
LIKFWNKWLKKYKTKLSANAGRENKKMLLMMFANALQLRLKSKKLFLLCFALIHVRLRACRWRADRRKCRIE

SEQ ID NO: 3378 - protein, 23 aa, Artificial Sequence
  Computer-generated peptide variant
RLRLLTKMLKRINRAEKAHCVIW

SEQ ID NO: 3379 - protein, 27 aa, Artificial Sequence
  Computer-generated peptide variant
KLRFYQKLMRRLKRARKALTLAARKRL

SEQ ID NO: 3380 - protein, 36 aa, Artificial Sequence
  Computer-generated peptide variant
KFRIFSRLLRLLQSWPRIFLAAAKYHGRLWKLDKAN

SEQ ID NO: 3381 - protein, 20 aa, Artificial Sequence
  Computer-generated peptide variant
FLKFLRRMLRKYPKAHEQKL

SEQ ID NO: 3382 - protein, 85 aa, Artificial Sequence
  Computer-generated peptide variant
FIKWFKKLWKKLTRCWRALACSGRWETFWKRVKKALYAARLYYMARVLPALCARGYLKTRGMDAKRRYSTRDLYRKWALKVLLWL

SEQ ID NO: 3383 - protein, 20 aa, Artificial Sequence
  Computer-generated peptide variant
LLKYITRLLKKWHKEANCKK

SEQ ID NO: 3384 - protein, 41 aa, Artificial Sequence
  Computer-generated peptide variant
MLKYYSKFLRRLRKHPLKKAFVKLAEPAKQVGYAAFPLLRI

SEQ ID NO: 3385 - protein, 20 aa, Artificial Sequence
  Computer-generated peptide variant
KFKLWKKLLRWFSTRGAQLR

SEQ ID NO: 3386 - protein, 29 aa, Artificial Sequence
  Computer-generated peptide variant
FMRWWQRLMKKYRRQLKAIQALLNAHARL

SEQ ID NO: 3387 - protein, 41 aa, Artificial Sequence
  Computer-generated peptide variant
YLKYFKRFYRKITCMRHGKAARAVLYSARRAAASLSASAVK

SEQ ID NO: 3388 - protein, 25 aa, Artificial Sequence
  Computer-generated peptide variant
KLKMFRRLFKMFQRHHLKQDKASAL

SEQ ID NO: 3389 - protein, 66 aa, Artificial Sequence
  Computer-generated peptide variant
IFKYMSKMLKKMSRTWFLLSGPLRHKNWLLRLARRKAELALRQNRGCQLIAHPLKLRARAKAIRKA

SEQ ID NO: 3390 - protein, 23 aa, Artificial Sequence
  Computer-generated peptide variant
FFKIFHRFLRLLRKRGSRLYNLA

SEQ ID NO: 3391 - protein, 46 aa, Artificial Sequence
  Computer-generated peptide variant
RLRWYQKWLKIFHRLPNQKMHAKKLKFIAAASNAQLLKHRRLIKRK

SEQ ID NO: 3392 - protein, 96 aa, Artificial Sequence
  Computer-generated peptide variant
KFRILTRLLRRWKRGGRNKHAGREYRAPRKRALKFGAWCYKGLKQLLLALQLLFHLTLGILERRERRRKKLCHLSRDRKAQDHRQEKMDVVILNDR

SEQ ID NO: 3393 - protein, 37 aa, Artificial Sequence
  Computer-generated peptide variant
LFKMYKKFYKRYRRMRAYFVPAACWKRLLLKLNAALT

SEQ ID NO: 3394 - protein, 41 aa, Artificial Sequence
  Computer-generated peptide variant
FYKIWRRIWKFLKRAFLKEAYAAAKLGACIHKKNLIPRAMK

SEQ ID NO: 3395 - protein, 46 aa, Artificial Sequence
  Computer-generated peptide variant
ILRLYTRLLKWLRSARKRLLARLLKMTCKGAAKSKKADNLIKPWAY

SEQ ID NO: 3396 - protein, 32 aa, Artificial Sequence
  Computer-generated peptide variant
RLRIFRRLIRKFCKRTLKLATKARLAAWECLA

SEQ ID NO: 3397 - protein, 70 aa, Artificial Sequence
  Computer-generated peptide variant
LMRIYRKFLRLLHKWQFRLECARKRCKAKRFIADCDYLPAYRAAIRAAEAKKAFLALKLEIKEKLYWFEA

SEQ ID NO: 3398 - protein, 71 aa, Artificial Sequence
  Computer-generated peptide variant
KLKFIQRILKRFKKLKYTWARGLTTLIRACDKKSLLARADHFAGAPKKDKANADMWILRFHRKRKRMALAL

SEQ ID NO: 3399 - protein, 71 aa, Artificial Sequence
  Computer-generated peptide variant
LLRLLKKFLKKLRRTRLLMLIVRLVLALRHRRLRNVAWKDWKAKKHCSHSLKCDNKEPRENLKKLNLSSKC

SEQ ID NO: 3400 - protein, 26 aa, Artificial Sequence
  Computer-generated peptide variant
KWKLLNKFMRLYRSWSALPAKRADWR

SEQ ID NO: 3401 - protein, 50 aa, Artificial Sequence
  Computer-generated peptide variant
FLRLFPRYLRRFHKAYAHCARLKAWIAAMALRTEKLRLRLTRAMRRKRRQ

SEQ ID NO: 3402 - protein, 32 aa, Artificial Sequence
  Computer-generated peptide variant
LFRLIKKYLRRWNTAIAKKRQGRYRLTAGALL

SEQ ID NO: 3403 - protein, 30 aa, Artificial Sequence
  Computer-generated peptide variant
LLRFMSKMIRKWKRRLAYIWLKHACKARHG

SEQ ID NO: 3404 - protein, 56 aa, Artificial Sequence
  Computer-generated peptide variant
KMRMMTRLWKWLHRSKARRRFSKYLRAKAKRSRDALASANSALANNREMALDHLAV

SEQ ID NO: 3405 - protein, 56 aa, Artificial Sequence
  Computer-generated peptide variant
LLKIMKKIMRLLHRSMKIKQAYAFVWAYAYATMHKARRMKKPILAEKHRKQLARLQ

SEQ ID NO: 3406 - protein, 62 aa, Artificial Sequence
  Computer-generated peptide variant
KLKFMRRLFKRFRPCALIYLNLKRRAALYDWSRGAAKFLWLPLWKKVRPMCWRIRDKALTLG

SEQ ID NO: 3407 - protein, 28 aa, Artificial Sequence
  Computer-generated peptide variant
LYRLLTKYIRRIQPMTARYLKLRRKKAA

SEQ ID NO: 3408 - protein, 29 aa, Artificial Sequence
  Computer-generated peptide variant
WWRLFSKIIRKLCKPRELAAEASQKKACR

SEQ ID NO: 3409 - protein, 81 aa, Artificial Sequence
  Computer-generated peptide variant
FWKMIRKWFRRYQKLRCACLRKHIMAVYRARRQRLGARAKPQMMKLCKFAYSLALSRLAFAGDAQKFLAIKAMARRWLRRN

SEQ ID NO: 3410 - protein, 69 aa, Artificial Sequence
  Computer-generated peptide variant
LLRFIKKLYRKLRRLMKPWMHIKSILILKDAPLAHLRRVLKWKGANAKCHKKRQMRRCPAGNDATACLL

SEQ ID NO: 3411 - protein, 33 aa, Artificial Sequence
  Computer-generated peptide variant
KLKIFRRWYKRLQKALLLGDRANRKRLRRLLWP

SEQ ID NO: 3412 - protein, 47 aa, Artificial Sequence
  Computer-generated peptide variant
WFKMYTRYLKKMKKGLGNAAAESLKTAQRDKILAFHKRQKLKAELRP

SEQ ID NO: 3413 - protein, 39 aa, Artificial Sequence
  Computer-generated peptide variant
LFRFLHRFMRRFHKLLCAVKKMALKNSFRKADLARSPLA

SEQ ID NO: 3414 - protein, 32 aa, Artificial Sequence
  Computer-generated peptide variant
WLKYLQKWLKRFTRGCRYAPRAALSAKAMHAI

SEQ ID NO: 3415 - protein, 21 aa, Artificial Sequence
  Computer-generated peptide variant
LIRMFRRYLRMLRQNRANRHL

SEQ ID NO: 3416 - protein, 59 aa, Artificial Sequence
  Computer-generated peptide variant
RFKWIRRFMRMWRKDRKLKLQNYYAQGHNRLRWRKALRLSALGNWKAELKWAKLMLRLK

SEQ ID NO: 3417 - protein, 20 aa, Artificial Sequence
  Computer-generated peptide variant
ILKIFPKLFKKLKPCLLAKR

SEQ ID NO: 3418 - protein, 53 aa, Artificial Sequence
  Computer-generated peptide variant
RIKIIKKWLKKINRRPLLVQADNRPIFMLWKALWLNPKLRTAAWMLKLLRRKK

SEQ ID NO: 3419 - protein, 55 aa, Artificial Sequence
  Computer-generated peptide variant
RLRMLQKMLKRWSPLLPLEKSSKRKARAALKRAKSSSRKDWGAHPLRLKAHKTHE

SEQ ID NO: 3420 - protein, 20 aa, Artificial Sequence
  Computer-generated peptide variant
KYKFFRRILRLMKRHIASLL

SEQ ID NO: 3421 - protein, 39 aa, Artificial Sequence
  Computer-generated peptide variant
WMKWMKRMLKRLQCQATKRLALATLNRRLMLKKAHPGSD

SEQ ID NO: 3422 - protein, 72 aa, Artificial Sequence
  Computer-generated peptide variant
IWKLLKRWLRRLTKLPNNPRKRRKNNLRQKPRRKLYAILKLLKKWVNPAAKHMKQRADNEKCGKAFYGAAIY

SEQ ID NO: 3423 - protein, 20 aa, Artificial Sequence
  Computer-generated peptide variant
FLRYLTRLYKKLTNARSKTL

SEQ ID NO: 3424 - protein, 25 aa, Artificial Sequence
  Computer-generated peptide variant
RMRLMCKLWKMWNRARLIAWASKGR

SEQ ID NO: 3425 - protein, 75 aa, Artificial Sequence
  Computer-generated peptide variant
WYKFLTRYLKWLRRCKLGRERKSGTYKNWACLRRREKSTPNLYYLSATAQAALAKRAKTAKRRADAAGPRAWPAR

SEQ ID NO: 3426 - protein, 29 aa, Artificial Sequence
  Computer-generated peptide variant
KIKLLQKFLKFFCPTSKSANAKALKVRMR

SEQ ID NO: 3427 - protein, 67 aa, Artificial Sequence
  Computer-generated peptide variant
KLRLLKKYYRIIRKLKLKSKREFKAVLRRILQALDFAPALPWATRDKLNLKCYDMQCYNPRRIAVRL

SEQ ID NO: 3428 - protein, 24 aa, Artificial Sequence
  Computer-generated peptide variant
LFKWMTKLIRKICKARDLDRAKNL

SEQ ID NO: 3429 - protein, 35 aa, Artificial Sequence
  Computer-generated peptide variant
RLRLYKRYFRKFRQSTFPHKIALLMQIKRAKALLR

SEQ ID NO: 3430 - protein, 30 aa, Artificial Sequence
  Computer-generated peptide variant
KMRMLQRYIKLWRRAALAKECREHLARRWM

SEQ ID NO: 3431 - protein, 40 aa, Artificial Sequence
  Computer-generated peptide variant
RLRMMCKLLRKYRKFKLKLWHRAHNLHLLKQLEWLRADQQ

SEQ ID NO: 3432 - protein, 25 aa, Artificial Sequence
  Computer-generated peptide variant
LIKILRKMLRYFKPRLSVIALKCKL

SEQ ID NO: 3433 - protein, 27 aa, Artificial Sequence
  Computer-generated peptide variant
LIKLYTKLLKYLCKRAASEYDVKLRYL

SEQ ID NO: 3434 - protein, 43 aa, Artificial Sequence
  Computer-generated peptide variant
LYRWFKRFIKFLKRNNLARLNYMSKRFLARMCCAAKPCAPAKK

SEQ ID NO: 3435 - protein, 43 aa, Artificial Sequence
  Computer-generated peptide variant
RLKLFRKWIKKFKSAAMLDVKAMRILVERTLNLRKLMSTLLGY

SEQ ID NO: 3436 - protein, 46 aa, Artificial Sequence
  Computer-generated peptide variant
RLKFWCKLLRKFKKFIPGAPLLQANLKYLAWRKKMLRKHSGDLAWE

SEQ ID NO: 3437 - protein, 53 aa, Artificial Sequence
  Computer-generated peptide variant
KLKLLPRLLRKIKKLKRNLVPDWALVGSAIAATMKMRRLLKTLKWNSLKVLLP

SEQ ID NO: 3438 - protein, 20 aa, Artificial Sequence
  Computer-generated peptide variant
KYRIFSRLIKRLRTAIAAMR

SEQ ID NO: 3439 - protein, 37 aa, Artificial Sequence
  Computer-generated peptide variant
FWRLLRRLLRWFRKLPKRKKLLKNANEGHCAELHKIV

SEQ ID NO: 3440 - protein, 33 aa, Artificial Sequence
  Computer-generated peptide variant
LLKLFKRLLRRWNKQRFKALYAFKMHHGHLLAI

SEQ ID NO: 3441 - protein, 43 aa, Artificial Sequence
  Computer-generated peptide variant
FIKFLRKMWRKFKKYGEKLLLQYKRIKLKATAKKGNALWLAAA

SEQ ID NO: 3442 - protein, 100 aa, Artificial Sequence
  Computer-generated peptide variant
RLRLYSRLLKRLPKRDTWLLCRLLLENLVRKQAWKMELLTFIKCEAERSVENRRAQNALCNEKLRIKYTKKMAHSCLRLQWAQQENDVLRRRNALARLRL

SEQ ID NO: 3443 - protein, 66 aa, Artificial Sequence
  Computer-generated peptide variant
KYKMFNKIFRIMKKANLKWPLLALAKMELAFKKAQRPRMPKKYRRDLLDSRNIRLYNAKCLAWHRK

SEQ ID NO: 3444 - protein, 32 aa, Artificial Sequence
  Computer-generated peptide variant
RFRYMHKLLKRYPHKKDTKAEASCLKAHRLAF

SEQ ID NO: 3445 - protein, 29 aa, Artificial Sequence
  Computer-generated peptide variant
RIKYMRKMYRLLKTRVLILKTARCALARV

SEQ ID NO: 3446 - protein, 74 aa, Artificial Sequence
  Computer-generated peptide variant
KFRYMKKLWRKFKRWTLRLGVRAKYRKRYVVKCWLKMRYDECVPLKLALAKASLRAQSIRKWSNASNCTKLLAR

SEQ ID NO: 3447 - protein, 33 aa, Artificial Sequence
  Computer-generated peptide variant
LMKMMRKLIRRLCRRLRKKAAWGDALVGSDRSL

SEQ ID NO: 3448 - protein, 23 aa, Artificial Sequence
  Computer-generated peptide variant
LLRLLNKLWRYLHRLTRHLTCRK

SEQ ID NO: 3449 - protein, 70 aa, Artificial Sequence
  Computer-generated peptide variant
MLKMIRRLYRYFRPTMKFLRLSKALRSRIRKRLGIEGFRRWKAKNLLLAKREGKAAILWLNKALTNPWFE

SEQ ID NO: 3450 - protein, 52 aa, Artificial Sequence
  Computer-generated peptide variant
LFKFMKRLLRKLQTDALLPAESAKGNKMARVLVAKAAMWERLSTFLLFRTKF

SEQ ID NO: 3451 - protein, 71 aa, Artificial Sequence
  Computer-generated peptide variant
RLKLLHRFFKIYKRAKNDNHKCYRAELENDHGALRRLFRRRLLASKKYALACLFKLRAGKHVGLYHKRFIF

SEQ ID NO: 3452 - protein, 68 aa, Artificial Sequence
  Computer-generated peptide variant
RLKLLSRLYKLWKQPLAKKPKLAWVQPAWLFFWKLKLHADDQKLKVFLGISKGNYACKMRRQRKKLAP

SEQ ID NO: 3453 - protein, 24 aa, Artificial Sequence
  Computer-generated peptide variant
WFRYLRRYLKKLKTSLMQKLRVIL

SEQ ID NO: 3454 - protein, 27 aa, Artificial Sequence
  Computer-generated peptide variant
KLRWMRRLFRLYRQLHLIAGGNWLERA

SEQ ID NO: 3455 - protein, 34 aa, Artificial Sequence
  Computer-generated peptide variant
RLRLLKRFYKIMRRHNDITSAKLAISKLEMLKHA

SEQ ID NO: 3456 - protein, 88 aa, Artificial Sequence
  Computer-generated peptide variant
RIRFYTKFWRRFTCLAKNWKQRLLLALRAPQKQMACKCRRKAEKKRNISALQLPARIGCRLRKACADKVFKLIYIARNLIEQDARKKK

SEQ ID NO: 3457 - protein, 23 aa, Artificial Sequence
  Computer-generated peptide variant
LIKLLNKMWKYLQRKKARCVNIL

SEQ ID NO: 3458 - protein, 26 aa, Artificial Sequence
  Computer-generated peptide variant
LMRFLKKLLKRMNRAALNRLNLGMKY

SEQ ID NO: 3459 - protein, 78 aa, Artificial Sequence
  Computer-generated peptide variant
LYRLLRRIIRRWRKRGACALQKRLSLVKKLKTWASIEAVALAAARKVMLQHQRKFAAIKSFEVCAKTCKNSIVMLNKR

SEQ ID NO: 3460 - protein, 45 aa, Artificial Sequence
  Computer-generated peptide variant
RFKLWNKMIKFINKKRPAKFKRLALCVCRPTAAQFLLAILAAERC

SEQ ID NO: 3461 - protein, 92 aa, Artificial Sequence
  Computer-generated peptide variant
RIRLIRKWLKRMTKRQLPLFFNAKGGKRAGLMKKAPIDPALALWNLEGRARAPFQRKDEPLAARKVVRKAKKAEKRFGNLKKLNMRQLPLRK

SEQ ID NO: 3462 - protein, 45 aa, Artificial Sequence
  Computer-generated peptide variant
RIRLYQRLFKKWCHAPNGKRNGTKKCKLAWLRMALKPQKQKTLLL

SEQ ID NO: 3463 - protein, 32 aa, Artificial Sequence
  Computer-generated peptide variant
KLRLLRKLFKWFHKVIRLVAWKNQRIYKAMAS

SEQ ID NO: 3464 - protein, 29 aa, Artificial Sequence
  Computer-generated peptide variant
ILKFLCKLFKMYRQGQTPKRCKAQKLKAL

SEQ ID NO: 3465 - protein, 34 aa, Artificial Sequence
  Computer-generated peptide variant
YMRLLRKLFRKLNKVVLKPCRLAWLHAHRGKFWN

SEQ ID NO: 3466 - protein, 21 aa, Artificial Sequence
  Computer-generated peptide variant
KLRLWKKLLKRFCPNLTWRLR

SEQ ID NO: 3467 - protein, 66 aa, Artificial Sequence
  Computer-generated peptide variant
KFKFWKKWLRKLKRKRLACKTAAHMAKLRQCEPPWGSRPARIEEFNVRNKELWLLLLLIRLNLRAL

SEQ ID NO: 3468 - protein, 79 aa, Artificial Sequence
  Computer-generated peptide variant
KYRFLKRLLRLFSKLHITVTLARNRPKVMLHHAQFKKEKTDEKQLWERAATKVHNLLGRGCSAIAKKKKAGLKEKLAKA

SEQ ID NO: 3469 - protein, 51 aa, Artificial Sequence
  Computer-generated peptide variant
KLKLLRKLLRLISKTNKMMRELLTFARRAKRLYKCWLMQCIYKRNRQMKFQ

SEQ ID NO: 3470 - protein, 56 aa, Artificial Sequence
  Computer-generated peptide variant
LLKWYCKFWKFFRCNRRPKLLAIHQKLNLNAKALIKALARRHAIMLKHLKKNKAPF

SEQ ID NO: 3471 - protein, 32 aa, Artificial Sequence
  Computer-generated peptide variant
FLRLLRRLYRIWKRYLAVNRLKLWRSSCLAWA

SEQ ID NO: 3472 - protein, 55 aa, Artificial Sequence
  Computer-generated peptide variant
WFRLLKRLIKRIRPWRYKARAIRATAKAKKLKLELVKQRCDLRRLLLQKFCIRPL

SEQ ID NO: 3473 - protein, 22 aa, Artificial Sequence
  Computer-generated peptide variant
LIKILKRLWKRLRPMHLAKALI

SEQ ID NO: 3474 - protein, 22 aa, Artificial Sequence
  Computer-generated peptide variant
FLRLWKKLMRRLRSRKAQAAAY

SEQ ID NO: 3475 - protein, 99 aa, Artificial Sequence
  Computer-generated peptide variant
RMRFMKRIYRKWRRALLLKQAAARRKDKLFRNKSKRFKMVNLRNTFLPRRATQKYNAMLVPTRKKHHCKANMLRLAALKQRHEPWAAKRLLCLRGKAIH

SEQ ID NO: 3476 - protein, 23 aa, Artificial Sequence
  Computer-generated peptide variant
KYKLFQKFLRFLRSCLRLISLNL

SEQ ID NO: 3477 - protein, 36 aa, Artificial Sequence
  Computer-generated peptide variant
KLRLLSKFYRLMSKRQLRLPLHKWFDILLHLRARKK

SEQ ID NO: 3478 - protein, 44 aa, Artificial Sequence
  Computer-generated peptide variant
KLRYFRRWMRMIHRRAAFRKDKCVFTAALPLLKEAMYKALNHLK

SEQ ID NO: 3479 - protein, 86 aa, Artificial Sequence
  Computer-generated peptide variant
RMRLWQKYYKYFRPAKKRKERTGKRKNATSKAEQAKFTAMPLRLKLLRALWECLLCRLVCPYRGARRKIYGGKNRRQTAEAARAAL

SEQ ID NO: 3480 - protein, 58 aa, Artificial Sequence
  Computer-generated peptide variant
RFKMLCRYLRIMRNACGGDWKLVAARMRDAAFKQLNRRMKHLQELAGVRDRKKAKLKV

SEQ ID NO: 3481 - protein, 41 aa, Artificial Sequence
  Computer-generated peptide variant
KIRMLKKWLKKLKRALAQFKSPGENRWRCCRAPKLHCLAAT

SEQ ID NO: 3482 - protein, 25 aa, Artificial Sequence
  Computer-generated peptide variant
LYRLFPRYLKKLRHFTIKDRNRLLL

SEQ ID NO: 3483 - protein, 38 aa, Artificial Sequence
  Computer-generated peptide variant
KMKFWCKLIKFLRRLHLRKWNAYGLEKLEKVADAPLLQ

SEQ ID NO: 3484 - protein, 65 aa, Artificial Sequence
  Computer-generated peptide variant
IYKLLNRLLRKWCKRTIHADKDALAQLSLARAAKRRGMAARALELTDAKRQTNPYQNDQAKRLHG

SEQ ID NO: 3485 - protein, 37 aa, Artificial Sequence
  Computer-generated peptide variant
RMRLLKRWWRKLRRYKAARSAEAPRESRMKIAGLDLQ

SEQ ID NO: 3486 - protein, 34 aa, Artificial Sequence
  Computer-generated peptide variant
KLRFFKRLLKRYQRVFRAWKLTADQAPRRLDAKL

SEQ ID NO: 3487 - protein, 20 aa, Artificial Sequence
  Computer-generated peptide variant
WIKILNRIFRRLKPAYRCAA

SEQ ID NO: 3488 - protein, 42 aa, Artificial Sequence
  Computer-generated peptide variant
FIRLFRKILKFLKKKALLKFRDARQDRPCAGSRRAPEIKAPL

SEQ ID NO: 3489 - protein, 26 aa, Artificial Sequence
  Computer-generated peptide variant
KLRLMKKLLRRFPRLACCRYLPACNN

SEQ ID NO: 3490 - protein, 48 aa, Artificial Sequence
  Computer-generated peptide variant
KYKMIKKYLKWITQALSKKARTRRCRMRLACLPRELATLARVHADTML

SEQ ID NO: 3491 - protein, 64 aa, Artificial Sequence
  Computer-generated peptide variant
KLRLYNKFLKKFKKTAKLCLDCRLHNKSHKLIALKMRAFKNKGAYKRACKLSFGAWLYYRLILD

SEQ ID NO: 3492 - protein, 22 aa, Artificial Sequence
  Computer-generated peptide variant
YLKLLKRLYRRWCRHKWCLTNL

SEQ ID NO: 3493 - protein, 50 aa, Artificial Sequence
  Computer-generated peptide variant
KLKWMPRLLRKFNKLDDAQRRRLSCLLSKKLTMARDHHHMLHRQRLRLYA

SEQ ID NO: 3494 - protein, 42 aa, Artificial Sequence
  Computer-generated peptide variant
IFRLITKLFKKFRKIRRPKQPRKRLLGAGLCAAIATHQARLE

SEQ ID NO: 3495 - protein, 54 aa, Artificial Sequence
  Computer-generated peptide variant
KFRYFPRFYRLLRNKIELAKKLYKAKARLLRMLDCVIYCEKGHKDAKQSRARLW

SEQ ID NO: 3496 - protein, 41 aa, Artificial Sequence
  Computer-generated peptide variant
RYKILRRLFKLMKRALLENRRIICKDFHACAASNAAQAMMR

SEQ ID NO: 3497 - protein, 50 aa, Artificial Sequence
  Computer-generated peptide variant
KFRFMKKLFKRYCRARLHLKRKKGAGQAHLKYPLVSRIVRWRYLAKAMLA

SEQ ID NO: 3498 - protein, 23 aa, Artificial Sequence
  Computer-generated peptide variant
RLKIYKRILKFLCCCENLLNARK

SEQ ID NO: 3499 - protein, 41 aa, Artificial Sequence
  Computer-generated peptide variant
KYRLIKRWYKRLKPAKNKLFKEAFARPWRKAAHARLAANLT

SEQ ID NO: 3500 - protein, 41 aa, Artificial Sequence
  Computer-generated peptide variant
LLRYLRRLYKMWCCLKRARARKALTAAYKYSRQVVVWLYKA

SEQ ID NO: 3501 - protein, 89 aa, Artificial Sequence
  Computer-generated peptide variant
RYKYLCRLFRYLKCAGLQAIWRQAHRAHGCPAKLPRTADKKLRQNKRAWWYGVRKMCHARARLLRAHIRIPKTREMRRDLLLFGAPRAL

SEQ ID NO: 3502 - protein, 52 aa, Artificial Sequence
  Computer-generated peptide variant
RFKWLRKLWRLLRREPKIQYPLIAIKKRCHHLYEAKHELALSNARWKCAALV

SEQ ID NO: 3503 - protein, 36 aa, Artificial Sequence
  Computer-generated peptide variant
IWKLYTKMLKKYHKYCALKCVALHRWRKAKWARVLP

SEQ ID NO: 3504 - protein, 65 aa, Artificial Sequence
  Computer-generated peptide variant
KLKFIPKYLKYYPRAHPVKENAVRYRALKLYSLMGQFRLKAKWLFLQAKRHRKKVARLARAHLLC

SEQ ID NO: 3505 - protein, 22 aa, Artificial Sequence
  Computer-generated peptide variant
KFKYLKRYLRRLPHAALDGAAG

SEQ ID NO: 3506 - protein, 44 aa, Artificial Sequence
  Computer-generated peptide variant
KMKLFKKWYKRLQRCAKGGKAKKIFAIAFYSAMALAKIERLRTA

SEQ ID NO: 3507 - protein, 22 aa, Artificial Sequence
  Computer-generated peptide variant
KLRLFKRLLRYLKCNATAMGRT

SEQ ID NO: 3508 - protein, 38 aa, Artificial Sequence
  Computer-generated peptide variant
FLKMFKRLIRKFSQLRYLLARAAEGLAMASRMVLRQRK

SEQ ID NO: 3509 - protein, 100 aa, Artificial Sequence
  Computer-generated peptide variant
LLRFYTRFMRRLRSEKLQGFIERFFARAKLNASLIHKREVDAAGQATCHWELLRLRKKKRKVRACKIAKRRRNKALLDNELCLALLLRYEALEMKECAAK

SEQ ID NO: 3510 - protein, 50 aa, Artificial Sequence
  Computer-generated peptide variant
FLKWLPRLLRKLRKNTARKLTALDRKKFQLRRELRSCRRAQVWEAIEDFT

SEQ ID NO: 3511 - protein, 44 aa, Artificial Sequence
  Computer-generated peptide variant
RWKFLRKYYRWWKCGTAWQSVRAKYYMCQLALKKAKARKLKAYA

SEQ ID NO: 3512 - protein, 86 aa, Artificial Sequence
  Computer-generated peptide variant
WLRFLKKILRLLPCRKELYFKRRAPFLRHIAIRQMAAAPGLLKKAALLRMRRCWPALRRKWAECAAILQKRSVHFDYKQVLHLKGK

SEQ ID NO: 3513 - protein, 60 aa, Artificial Sequence
  Computer-generated peptide variant
KFRLLPRYLRWYRSRARYALEGYLRGKLMKRRFRKHLFKQKAKVIVLLMMALLLMAEVES

SEQ ID NO: 3514 - protein, 30 aa, Artificial Sequence
  Computer-generated peptide variant
RIKMLTKFLRWMKRYLMAPKRLLVDRLHLK

SEQ ID NO: 3515 - protein, 38 aa, Artificial Sequence
  Computer-generated peptide variant
KMRLYKKLLRIYKTFKFMTLRGACANRLASKLNNNCLK

SEQ ID NO: 3516 - protein, 64 aa, Artificial Sequence
  Computer-generated peptide variant
RLKMLTKIFRKLHQKYRSKRRALAKFCALARWFKRLRLRHFAQRRQSTLDREAFWIVKSRGCIL

SEQ ID NO: 3517 - protein, 35 aa, Artificial Sequence
  Computer-generated peptide variant
RMKLFQRYLRKFPNRLLNACKQQRAGLDELLRAKK

SEQ ID NO: 3518 - protein, 77 aa, Artificial Sequence
  Computer-generated peptide variant
RYRWFPRYIKLLKKLDRARPACDYKKSCKLLGKKSPVARWTKAIKLVYLKGMRRLAKLLHPRCAKLLAKLQAAPVHA

SEQ ID NO: 3519 - protein, 42 aa, Artificial Sequence
  Computer-generated peptide variant
RIKLLKKLIKKLQKMSAYRRRQALRIILRAVAALIRLLPKNG

SEQ ID NO: 3520 - protein, 94 aa, Artificial Sequence
  Computer-generated peptide variant
KLRFFRKMLKKLKTHFLVRECRKERAIRLRQNNFLTRAACRGASKKNFARFWDKRAARQLARTGSRLTKATLNLFAAQLECSRPDKLREQKVAI

SEQ ID NO: 3521 - protein, 37 aa, Artificial Sequence
  Computer-generated peptide variant
KYRLYKRYLRRLRKLLHRRQKFLMLLFDENAWYASLG

SEQ ID NO: 3522 - protein, 33 aa, Artificial Sequence
  Computer-generated peptide variant
RIKILHKLWRRWHKMLLLSVDNRPLAAIKQLAR

SEQ ID NO: 3523 - protein, 29 aa, Artificial Sequence
  Computer-generated peptide variant
RLKMMQRWLRRLNQKAALFDHLLVKSDQR

SEQ ID NO: 3524 - protein, 23 aa, Artificial Sequence
  Computer-generated peptide variant
LLRLMNRFWRRFRRALLAARRPG

SEQ ID NO: 3525 - protein, 69 aa, Artificial Sequence
  Computer-generated peptide variant
RMKLWKKLYRFFKQLEMPALSKKRALLAKMCFRKMLRYCLDQHALFLHKRNMTLNDRLFLKLWTKARTW

SEQ ID NO: 3526 - protein, 56 aa, Artificial Sequence
  Computer-generated peptide variant
KLKYYKKFLRRYCHRKLFRWLTSLRRAARKALLNYHQVCQLLKKKKMMATWKNHCL

SEQ ID NO: 3527 - protein, 32 aa, Artificial Sequence
  Computer-generated peptide variant
RFRMWRKLLRRWSPLKAVIHAALRYVSARACR

SEQ ID NO: 3528 - protein, 82 aa, Artificial Sequence
  Computer-generated peptide variant
KLRFFQKIMKRYQSRLRLEAVKNAVIRPGLMRYRDLRRLLAFYLKRYLKRSNILWLKVMAASIRRAIKHRRTPLSLNRKLAI

SEQ ID NO: 3529 - protein, 33 aa, Artificial Sequence
  Computer-generated peptide variant
KLRFFRRFFKLYKHFHAAKAKGIAKVDLLDLGL

SEQ ID NO: 3530 - protein, 78 aa, Artificial Sequence
  Computer-generated peptide variant
RFKIYQKLIRRIKTLAVLAAARTAINAAVLCRALKTKAKRKAAFIRLANPMKLNMSHKIAMKWPVMALRMRKAGHRQR

SEQ ID NO: 3531 - protein, 34 aa, Artificial Sequence
  Computer-generated peptide variant
RLKYWKKLWKKLRRWGGRKPLLCYTLGYYCAAKD

SEQ ID NO: 3532 - protein, 73 aa, Artificial Sequence
  Computer-generated peptide variant
FWRLLRRLMRKLKQKSHAKRIQLRAHKIKRPIKLKAGWPRFMKDKMFAKWADQILINAIVQKAYAAAANADAK

SEQ ID NO: 3533 - protein, 97 aa, Artificial Sequence
  Computer-generated peptide variant
KLRILRRFFKKYKTVAAKSMKLCWAAAWDARSPAADKEALNTLDCKAATNHIELSNQHARKMFLGIERLESRKAARLLRRLATWLWLPRDKRQRKKL

SEQ ID NO: 3534 - protein, 27 aa, Artificial Sequence
  Computer-generated peptide variant
LFKFWRKLLRRIQKAAALFKDGRDAYQ

SEQ ID NO: 3535 - protein, 66 aa, Artificial Sequence
  Computer-generated peptide variant
RMRMLRKLFRKIKPKYCRRGAEAAYLKMRHILYKRPETCVLRIRRWKKVMMRLPGAKCKLAAVLLA

SEQ ID NO: 3536 - protein, 44 aa, Artificial Sequence
  Computer-generated peptide variant
KMRFYRRLYKKFRNHNAAARLTRHPANETQQERFAGKRKLLLRL

SEQ ID NO: 3537 - protein, 98 aa, Artificial Sequence
  Computer-generated peptide variant
RMRFWKRLLRIIRKAKAKAKQHNRKADVHAYKKPNGYAAWRNVKERRAAAAVGRCDHHTPLAVLYPVFEKRVIAWALIRPLRLLAWPLAANKKAMKEA

SEQ ID NO: 3538 - protein, 32 aa, Artificial Sequence
  Computer-generated peptide variant
LIRFYRRLLKKMRRRRMHTRTLHRLALDADYL

SEQ ID NO: 3539 - protein, 56 aa, Artificial Sequence
  Computer-generated peptide variant
KLKMFRKLLKRYNCAFQKKMATKVALVALQLLAIVRPLWPKCKKRTKRVKVHRAFL

SEQ ID NO: 3540 - protein, 74 aa, Artificial Sequence
  Computer-generated peptide variant
RMKLFRRFIRILSRFTARARQHRVNLRRLKPLLLRYKCHALSPVMLKACLALMMWKKLMPHKYRKLMARKRNKI

SEQ ID NO: 3541 - protein, 96 aa, Artificial Sequence
  Computer-generated peptide variant
RWRWFRKIFKRWKRSLRRWDAAKWAKSLWARYAKPRALIWHMRPHAKYLHGARKRRGFKRNASRKMIKLMMKARLKDENALEADYKPAIHKLSIAD

SEQ ID NO: 3542 - protein, 36 aa, Artificial Sequence
  Computer-generated peptide variant
RLKYYRKFLKYLCKLRHAPKKRLNAKKIRMAALWVW

SEQ ID NO: 3543 - protein, 27 aa, Artificial Sequence
  Computer-generated peptide variant
RMRLLCKLMKKLRSAKLMWWRDLLRKL

SEQ ID NO: 3544 - protein, 31 aa, Artificial Sequence
  Computer-generated peptide variant
KLKYFRKMLRKWTRWEKLLFRAAAEVDAAAI

SEQ ID NO: 3545 - protein, 41 aa, Artificial Sequence
  Computer-generated peptide variant
KLRFLRKLFKKFRKRAARRASKPVAALGTLRRAPLHHLARA

SEQ ID NO: 3546 - protein, 92 aa, Artificial Sequence
  Computer-generated peptide variant
WLKFFRKFFRRFRSAAITNQRALAAYGLAVANRPSKVEPSKKKAKKCRIWKAAAKAKIDKCAQCAKRMKKLEWKAKLVAKHKKQLLCGAKKI

SEQ ID NO: 3547 - protein, 34 aa, Artificial Sequence
  Computer-generated peptide variant
KLRFWPRFLKLFKKAVFKLIAAKVAKLRRELHMG

SEQ ID NO: 3548 - protein, 23 aa, Artificial Sequence
  Computer-generated peptide variant
RLKIFPKLLKRLTRAPTKTATWK

SEQ ID NO: 3549 - protein, 32 aa, Artificial Sequence
  Computer-generated peptide variant
ILRLLKKFMKKLRSPICACEPAAAMSHKKKLA

SEQ ID NO: 3550 - protein, 70 aa, Artificial Sequence
  Computer-generated peptide variant
MLRLLRKLFKRIKKARWHWGSWKREKAQLLRLPRAKLLFAVTEWVLWKSRGVNRRSLGAAVRQWYKCRPA

SEQ ID NO: 3551 - protein, 89 aa, Artificial Sequence
  Computer-generated peptide variant
RFRWIRRYYKRMRRRRYRLRMKWKFALSRMADLEARCYLWKSKPQLYHHQDLYRRLIRTLKKLFAWKIVKALSCLQILASKHAKKKPLL

SEQ ID NO: 3552 - protein, 54 aa, Artificial Sequence
  Computer-generated peptide variant
RLRMIKKLWKYLNKKAGALMSDLYKFKFLLEARMKRARANNVLTSLLLYDFHTR

SEQ ID NO: 3553 - protein, 42 aa, Artificial Sequence
  Computer-generated peptide variant
KLKFLCRFFKLWRQKQNKLQKAHPNRRQRLQHAKKGLGLTAA

SEQ ID NO: 3554 - protein, 50 aa, Artificial Sequence
  Computer-generated peptide variant
RLKFLRRFYKKMRKARAMRCPKVAKLLCKQRAANLSLQGISSKDVLKIKL

SEQ ID NO: 3555 - protein, 21 aa, Artificial Sequence
  Computer-generated peptide variant
KYRLLRRFLKLFPCLTGRKSE

SEQ ID NO: 3556 - protein, 20 aa, Artificial Sequence
  Computer-generated peptide variant
LYRILRKLLKRMTTATYKAV

SEQ ID NO: 3557 - protein, 27 aa, Artificial Sequence
  Computer-generated peptide variant
FLRYWRRWMRLFRKYARHTLLVTATKL

SEQ ID NO: 3558 - protein, 50 aa, Artificial Sequence
  Computer-generated peptide variant
RLRFFRKWFRKFHSAILLALLVKVVNRALMRRIRAASLFREFDAFHALRM

SEQ ID NO: 3559 - protein, 92 aa, Artificial Sequence
  Computer-generated peptide variant
YFKYLTRFLKYWNRRGIHKAWALAPKALEKAKHNVSLEKKLRLRLTRKVSLALWRHFAVRAIAKARASLALLEDLPIFRYAIHSYWKKRKKK

SEQ ID NO: 3560 - protein, 47 aa, Artificial Sequence
  Computer-generated peptide variant
RLRLWRKMMRLLPKKARHCFGLERKMEQIANAKIAMCKGLAARIAKN

SEQ ID NO: 3561 - protein, 21 aa, Artificial Sequence
  Computer-generated peptide variant
IFKWMRRLFKKYTRQLRLALC

SEQ ID NO: 3562 - protein, 51 aa, Artificial Sequence
  Computer-generated peptide variant
LWRFWRRLWRRLRKRIMALPAEAKYRRFERLCHTCAERRLRTNRKVVLYAV

SEQ ID NO: 3563 - protein, 28 aa, Artificial Sequence
  Computer-generated peptide variant
LYKFYCKLLKLLRKKALFASKRQFLGSR

SEQ ID NO: 3564 - protein, 21 aa, Artificial Sequence
  Computer-generated peptide variant
LWRMYKKLIKRLRQRMQALRA

SEQ ID NO: 3565 - protein, 95 aa, Artificial Sequence
  Computer-generated peptide variant
KYRILKRLIRLMRRNANMRDKARTKTMRKLRMATFLRGLWWAPRMKGALLFTSARRLHTDAWEWSALDREARLHKGFRKKATNLWSAALACRNRK

SEQ ID NO: 3566 - protein, 40 aa, Artificial Sequence
  Computer-generated peptide variant
LFRLLCRWWKKFKKAAAFIGRAKSQKRNLAEAKGGWKKKV

SEQ ID NO: 3567 - protein, 21 aa, Artificial Sequence
  Computer-generated peptide variant
YMRLITRLIKKLRKWLANAPQ

SEQ ID NO: 3568 - protein, 66 aa, Artificial Sequence
  Computer-generated peptide variant
LLRWLKRWYKKWPSRVKPNRIKQAARAKKRHVATSTIRKPMHAKCREARFWGRALTLDQLWRRAAA

SEQ ID NO: 3569 - protein, 95 aa, Artificial Sequence
  Computer-generated peptide variant
WLRMFKRFMKFMKQAFAIVLEKAWNREKLALERKWLKARDKKRPARGREELKKRLVCARVTDARMLNCEKLQAHLALLNAAAGFLFKLAYLMAKA

SEQ ID NO: 3570 - protein, 52 aa, Artificial Sequence
  Computer-generated peptide variant
KLKYMKRWYRRFKHCRLIRRAPKCLLTKLIAALRKCALRHAKCALCAAKRLL

SEQ ID NO: 3571 - protein, 25 aa, Artificial Sequence
  Computer-generated peptide variant
LWRIFQRMYRKFNRLFLLAKDLPKL

SEQ ID NO: 3572 - protein, 69 aa, Artificial Sequence
  Computer-generated peptide variant
FLKFYRRWMRMLKREHSLRCHKQKKSYYSLSKRDKYKRARMLAAKLKLAKSCRRYPRLDIFQTLLFLTL

SEQ ID NO: 3573 - protein, 29 aa, Artificial Sequence
  Computer-generated peptide variant
RMKLLKKLYRWWKKMRCLAALQAARGTKL

SEQ ID NO: 3574 - protein, 25 aa, Artificial Sequence
  Computer-generated peptide variant
RMRLFSKFFRRLKQLRWPILNFAAL

SEQ ID NO: 3575 - protein, 77 aa, Artificial Sequence
  Computer-generated peptide variant
MLKWLNRFLRLFRRKAKGVKGKRTLAMKIHMRAAELRMRDFYIKPPLHRRGKDILMGRAHARAKRMLHHAKIARASH

SEQ ID NO: 3576 - protein, 40 aa, Artificial Sequence
  Computer-generated peptide variant
LWKYMTRILKLYRNYRIYYHIKKADDLKLAKHASKKLRAT

SEQ ID NO: 3577 - protein, 46 aa, Artificial Sequence
  Computer-generated peptide variant
MWKYIKKFYKKYNRALAKLKPRAKVMQATRFLLAKKYTFARLALTG

SEQ ID NO: 3578 - protein, 24 aa, Artificial Sequence
  Computer-generated peptide variant
RLKLIRKMLRKIKHRTSQACAGAA

SEQ ID NO: 3579 - protein, 63 aa, Artificial Sequence
  Computer-generated peptide variant
RLRWLRRFIRKMRNARVHLKLPDKNKRGLRAAKLYMYRYALDSAKIVDSFAAWSCRFLADLKA

SEQ ID NO: 3580 - protein, 43 aa, Artificial Sequence
  Computer-generated peptide variant
RLKFISRFFKKLCKKMALAQALYKAPRRFRTAVIACADAKVLL

SEQ ID NO: 3581 - protein, 22 aa, Artificial Sequence
  Computer-generated peptide variant
RLKLLCRLFRRLRRRQNANIVN

SEQ ID NO: 3582 - protein, 60 aa, Artificial Sequence
  Computer-generated peptide variant
ILRLWKKIFKLLKRRNLQRCLKHCTRARRLVGMFHLEDACAGKAWKKACSRKQNLPAYAA

SEQ ID NO: 3583 - protein, 40 aa, Artificial Sequence
  Computer-generated peptide variant
LLKWLKRWLKLLRKNGYDWWMKALRGPTRLANKRSQKKAM

SEQ ID NO: 3584 - protein, 30 aa, Artificial Sequence
  Computer-generated peptide variant
KWRMFRRLMRLLKTLNKARDHTLAMAGIRR

SEQ ID NO: 3585 - protein, 47 aa, Artificial Sequence
  Computer-generated peptide variant
IFRLLRKLLKRYRQLKRSEQTGRRKDWFFFLARQLALTNRVVKLDLL

SEQ ID NO: 3586 - protein, 56 aa, Artificial Sequence
  Computer-generated peptide variant
RYRFLCKILKLMCHTEGKAIRCRRACRAALLHKVHRKRATLMRKEKKLIDRLCLLK

SEQ ID NO: 3587 - protein, 27 aa, Artificial Sequence
  Computer-generated peptide variant
MIKFWKKYLRFLKQLFRANHLKRLRAG

SEQ ID NO: 3588 - protein, 52 aa, Artificial Sequence
  Computer-generated peptide variant
LIRMMRRLLKKLRRNPDMKAQYALKRVLKLLAAPSHDKNHSALRLFVRRREC

SEQ ID NO: 3589 - protein, 28 aa, Artificial Sequence
  Computer-generated peptide variant
RLRFYKRWWKILHKWCAKSMLRRAAADV

SEQ ID NO: 3590 - protein, 25 aa, Artificial Sequence
  Computer-generated peptide variant
LYKIYRKMLKIINSAWRRILNLKLR

SEQ ID NO: 3591 - protein, 100 aa, Artificial Sequence
  Computer-generated peptide variant
KLRYLRRLLKRYNKNRCRKALLLLRPFHAMKLQNVLRHYAELRSYAMFAQGALKQGAALEKPRPNSAKKRKFRATSLEAPHKSHPALPRRRLLRVIDYAQ

SEQ ID NO: 3592 - protein, 35 aa, Artificial Sequence
  Computer-generated peptide variant
LIKLLRRLLKKFPKAEAIARAKSRQRNAWLRNHCD

SEQ ID NO: 3593 - protein, 22 aa, Artificial Sequence
  Computer-generated peptide variant
RFRMFKKFWKLFRKTKPLALAA

SEQ ID NO: 3594 - protein, 40 aa, Artificial Sequence
  Computer-generated peptide variant
YWKLMKKLIKLFRRIARRKTALNRTKCKTALSRGGKAQLY

SEQ ID NO: 3595 - protein, 61 aa, Artificial Sequence
  Computer-generated peptide variant
LLKLMKRLLRRMKRSRRFLELQNQAAEANKWEWLLKKLCKWIKARVNARIIALMNIELSDA

SEQ ID NO: 3596 - protein, 27 aa, Artificial Sequence
  Computer-generated peptide variant
RLKLFRKILKFFCHLRAWSQQYAKLAV

SEQ ID NO: 3597 - protein, 27 aa, Artificial Sequence
  Computer-generated peptide variant
RLRFLRRYLRFLKRKNLTACRQFPLQS

SEQ ID NO: 3598 - protein, 72 aa, Artificial Sequence
  Computer-generated peptide variant
RFKYIKRYLKLWRTTRTKMRKEQAVVLVVRKYAKLKLKYVLLRQAAWLTSKRKERLAILLYLARLQRVDFKA

SEQ ID NO: 3599 - protein, 60 aa, Artificial Sequence
  Computer-generated peptide variant
WFRLFPKIFRRLKTCAIRLVQDRAHNYFDRNIKKALRAARILNRKRLATWTKLQKRPLAF

SEQ ID NO: 3600 - protein, 55 aa, Artificial Sequence
  Computer-generated peptide variant
LFKFFNKYFRLMSKNARRRDGLWAWRLEQRALFAVLAARRKQLRSAIKALTHLRK

SEQ ID NO: 3601 - protein, 33 aa, Artificial Sequence
  Computer-generated peptide variant
YLKLIRRFLKKMRNSQRRRARWARLLSNKAFAA

SEQ ID NO: 3602 - protein, 21 aa, Artificial Sequence
  Computer-generated peptide variant
LYKWLTRFIRLLNRRWKAHMR

SEQ ID NO: 3603 - protein, 28 aa, Artificial Sequence
  Computer-generated peptide variant
KFKIIKRLFRFLKQCAKLLKAQTATCLS

SEQ ID NO: 3604 - protein, 64 aa, Artificial Sequence
  Computer-generated peptide variant
FIKFYKRLIKMFKRKERGLHCPNAALAKEAPHLCVPKKNYAAHLCKSRFARIKLRLLMARRANL

SEQ ID NO: 3605 - protein, 58 aa, Artificial Sequence
  Computer-generated peptide variant
RLRYLKRFFRFLHKFLPVSKKELRLRVRQDFAACAILHKYLRCLANRARTPRELRRFA

SEQ ID NO: 3606 - protein, 35 aa, Artificial Sequence
  Computer-generated peptide variant
RIRLFTKLLKKYKQFDFGATSIVKARRKLALAKLV

SEQ ID NO: 3607 - protein, 24 aa, Artificial Sequence
  Computer-generated peptide variant
LMRWLKKLFRWFHRKYALKLVKRL

SEQ ID NO: 3608 - protein, 45 aa, Artificial Sequence
  Computer-generated peptide variant
FLKLLHRFWKKMQQLKAKEKAFMNWCKHAADALAIKCRMDARLGK

SEQ ID NO: 3609 - protein, 59 aa, Artificial Sequence
  Computer-generated peptide variant
LWRWLCKLFRRFKKLQIVCLARECKQCGGLLKAQKSTLMAKLREHRAGDLKLAKFLWKM

SEQ ID NO: 3610 - protein, 39 aa, Artificial Sequence
  Computer-generated peptide variant
FWRLLKRFFKLFNRRLARIAQIQYLYHHLARPRLLLACR

SEQ ID NO: 3611 - protein, 20 aa, Artificial Sequence
  Computer-generated peptide variant
LLRLMKKLFKFLTPRARYVC

SEQ ID NO: 3612 - protein, 70 aa, Artificial Sequence
  Computer-generated peptide variant
KLRFLRRLLKKIRNALAVADTRGRHGAGSKAKRANRDLKLRPKLPTDWKDLMRNCARNRLALKCKGACNA

SEQ ID NO: 3613 - protein, 69 aa, Artificial Sequence
  Computer-generated peptide variant
WMRLYRKMWRRLKCKGKPAAAGKFRATKGNARAARKCQLLHCMKLPDKAGCIRDKEYVKLRARLMARHT

SEQ ID NO: 3614 - protein, 34 aa, Artificial Sequence
  Computer-generated peptide variant
KMRLFQRLIRLWHQRLKAWNLKRLLPAASKKISQ

SEQ ID NO: 3615 - protein, 95 aa, Artificial Sequence
  Computer-generated peptide variant
KLRLYRKIYRRIHRRLRQRRMPLTRALLWFKMAIQRWHKLHNKSNDLNANKGLLADACKNRLLLIHVHKRRKTHFLLKLDAYLAASYAMCAADAF

SEQ ID NO: 3616 - protein, 30 aa, Artificial Sequence
  Computer-generated peptide variant
RLRFFRKLLKLITRYERKADAAHEMAFKIK

SEQ ID NO: 3617 - protein, 45 aa, Artificial Sequence
  Computer-generated peptide variant
RLKLIRKIYKLIKKKCFKSKLQLARLRLPRHLLLGALKEMLIRMR

SEQ ID NO: 3618 - protein, 61 aa, Artificial Sequence
  Computer-generated peptide variant
FLRLLQKIIRLLCKINLAKLRQFKAFIVYYERRAEARRLNEMMKHRKLVAGALRCCFAPRK

SEQ ID NO: 3619 - protein, 24 aa, Artificial Sequence
  Computer-generated peptide variant
RLRLMKKLMKLMRNHKHFVLRHLA

SEQ ID NO: 3620 - protein, 22 aa, Artificial Sequence
  Computer-generated peptide variant
FLKLLRKMLKKYCNGSEKKLAS

SEQ ID NO: 3621 - protein, 47 aa, Artificial Sequence
  Computer-generated peptide variant
KWRFMRRIYKKMRKALGKRRKLKAKAALCRLRAFMVCKAALALYEKS

SEQ ID NO: 3622 - protein, 85 aa, Artificial Sequence
  Computer-generated peptide variant
IFKLLPKLMRRLNSPALHRAREAWLNAHDKARSDRRMFLKAYTWDFYRFPAAFALLYKRKAKRRNGVCLLHAFRARRAFTMKQYR

SEQ ID NO: 3623 - protein, 41 aa, Artificial Sequence
  Computer-generated peptide variant
LLRYFKKMYKRWKTRKGQANPLLRGLAVWKARAIILIMRRG

SEQ ID NO: 3624 - protein, 43 aa, Artificial Sequence
  Computer-generated peptide variant
RIRWLRRYLKFYPTRALALALNKKRRWGRLYDARFIARLAMLN

SEQ ID NO: 3625 - protein, 73 aa, Artificial Sequence
  Computer-generated peptide variant
LLRLIQRLLRKWCRFNVANNFASKWRLMSAQRVLAADRNKKLHFWSLYKKRRRLLHLVVRLPGKHAARAKEVM

SEQ ID NO: 3626 - protein, 67 aa, Artificial Sequence
  Computer-generated peptide variant
KLRIIKKILKRLTKASQKRLPALNDRRLQLKRLLLMGACSIRWDELLLNRREKSAHDYHLAHHEAAK

SEQ ID NO: 3627 - protein, 43 aa, Artificial Sequence
  Computer-generated peptide variant
KLKLMKRYWKLLRRAAAAQKYNVGCLFNACILSRKQKRKEKWD

SEQ ID NO: 3628 - protein, 61 aa, Artificial Sequence
  Computer-generated peptide variant
KYRMFRKMFKKFRNLAKTAKALRKRLWRGARGCQQLKYLNNAAKAEWKKGGYLAAEETVRL

SEQ ID NO: 3629 - protein, 53 aa, Artificial Sequence
  Computer-generated peptide variant
YYKLLCKLMRRLKRYRVKLWRRQAKAARKDMARIRSAALAAALKILREKLIET

SEQ ID NO: 3630 - protein, 20 aa, Artificial Sequence
  Computer-generated peptide variant
LLRMFHKIIKILHCRQRLAA

SEQ ID NO: 3631 - protein, 20 aa, Artificial Sequence
  Computer-generated peptide variant
WFKIMTKLLKRLKPKHVAAQ

SEQ ID NO: 3632 - protein, 24 aa, Artificial Sequence
  Computer-generated peptide variant
FWKYLKKILRKLTRAWRLYTCRLA

SEQ ID NO: 3633 - protein, 51 aa, Artificial Sequence
  Computer-generated peptide variant
YFRWMKRLIKLLRRARHKRDKKHMSNKSAMFLRAHARLKCTYKRLIFMLQA

SEQ ID NO: 3634 - protein, 81 aa, Artificial Sequence
  Computer-generated peptide variant
RWRILRRWMRKMHHSLKYHRLKAVAADKNGIAATKLTAGSRAHKKVTARWPRLKCRLNRKRLILLLALKAASLEAALADAT

SEQ ID NO: 3635 - protein, 33 aa, Artificial Sequence
  Computer-generated peptide variant
RLRIMRKYYRKMPNQRLSAAAFRAAAMITWRLR

SEQ ID NO: 3636 - protein, 42 aa, Artificial Sequence
  Computer-generated peptide variant
RMRLLNKYLRLWKKRQLDKLSRKVLLMEYKLLEIAYKIRAYA

SEQ ID NO: 3637 - protein, 52 aa, Artificial Sequence
  Computer-generated peptide variant
KFRILCRWLKKLRHANFKAVCKRKAACHLLLAKYDLAAARRKRAKHKHLVNK

SEQ ID NO: 3638 - protein, 27 aa, Artificial Sequence
  Computer-generated peptide variant
RFRWLCRFMKFFNSAAAQRFAAAAKLK

SEQ ID NO: 3639 - protein, 38 aa, Artificial Sequence
  Computer-generated peptide variant
LWRIIRRFIKRFRHKKERSLPRPCSAKLLEVGAPKLAL

SEQ ID NO: 3640 - protein, 32 aa, Artificial Sequence
  Computer-generated peptide variant
KWRLLKRLLRKFQSNRQKNLACGKMSCHGKLL

SEQ ID NO: 3641 - protein, 45 aa, Artificial Sequence
  Computer-generated peptide variant
FLRMYRRFWRKLRRKLALSEKTQPLRIYESACKDADAHSWLAKAL

SEQ ID NO: 3642 - protein, 70 aa, Artificial Sequence
  Computer-generated peptide variant
RYKLIKKLLRKIRPLTKRLLKRHMGWIALTARSALMAIDNRRPGALQLAYPKLKQMRARGPLDKWPKAYY

SEQ ID NO: 3643 - protein, 35 aa, Artificial Sequence
  Computer-generated peptide variant
ILRLLKKWYKWLRKDEPYLALKRKDYRAVKKSAIL

SEQ ID NO: 3644 - protein, 59 aa, Artificial Sequence
  Computer-generated peptide variant
KWRFIQRYFKLFHKLAQQWPRCLANLMTKLILLLMYKAYKALRLRKRDPPYRARAMKKE

SEQ ID NO: 3645 - protein, 34 aa, Artificial Sequence
  Computer-generated peptide variant
KYRYWQKFFKYLKKPKPALAILKALKIRLQRDGF

SEQ ID NO: 3646 - protein, 21 aa, Artificial Sequence
  Computer-generated peptide variant
YIKYLRKWIKMLSNLRKLLFR

SEQ ID NO: 3647 - protein, 27 aa, Artificial Sequence
  Computer-generated peptide variant
MYKFYKKFLRLLRKLTIHAKDSRQKAL

SEQ ID NO: 3648 - protein, 36 aa, Artificial Sequence
  Computer-generated peptide variant
RMRFWRRIYRRINPRAYNPKAALLLKAKLFDFRWTA

SEQ ID NO: 3649 - protein, 37 aa, Artificial Sequence
  Computer-generated peptide variant
LIRFFKRWLRFFKRRDLWLALLIRGCMTKQLDADRKA

SEQ ID NO: 3650 - protein, 75 aa, Artificial Sequence
  Computer-generated peptide variant
KFRWIKRMMKRLHKHLLSAAKALARMHDIAVAWTLKKQAKRFIKSALALEGHDKVAAAKTKLRYFMKKNKSPRCA

SEQ ID NO: 3651 - protein, 37 aa, Artificial Sequence
  Computer-generated peptide variant
RLRIFRKIFKKIRNLCQRKHAMLLEKGANKCAFLELK

SEQ ID NO: 3652 - protein, 20 aa, Artificial Sequence
  Computer-generated peptide variant
KLKLLSKFLRIYCPGLNKRK

SEQ ID NO: 3653 - protein, 69 aa, Artificial Sequence
  Computer-generated peptide variant
WYKFMRRLIRRFKRRRQAKCWKIMIKATLVAAKRKMTFWRPLALRAKYARRNCLELLSFALPPESHLRK

SEQ ID NO: 3654 - protein, 22 aa, Artificial Sequence
  Computer-generated peptide variant
KFRIIKKLWKFLRKQLLKAAFT

SEQ ID NO: 3655 - protein, 70 aa, Artificial Sequence
  Computer-generated peptide variant
KFKMLRKLLRFWKSWKKKFWPAWLAISFKYAADKKKNCAATDYCRRGLVRRKLLHRLAGLKLARVRASQL

SEQ ID NO: 3656 - protein, 64 aa, Artificial Sequence
  Computer-generated peptide variant
LYKYWRKLLKLFPKAWPRAAAQRSVKIRSRARLSGPKARLAMSLVLAKCNHKHKWNLIRLRKIK

SEQ ID NO: 3657 - protein, 80 aa, Artificial Sequence
  Computer-generated peptide variant
LLRLLKKIWKYLSNNKMALWSAQPYAARTLQVLRVRPCKKAMCARSRMKEARICRHRLKRLFNRFTWALALPKRGLRDLR

SEQ ID NO: 3658 - protein, 53 aa, Artificial Sequence
  Computer-generated peptide variant
KIKLMQRLIRKFKRKLDASLKWWRLERLANAAMFKRSKLHKMWAPLYLRKTQW

SEQ ID NO: 3659 - protein, 60 aa, Artificial Sequence
  Computer-generated peptide variant
KFRWFPKWWRRMKCQNKARKLKLEREFMRLLGTERHSLDRLKRLAALEAKAVLTRDRHCN

SEQ ID NO: 3660 - protein, 57 aa, Artificial Sequence
  Computer-generated peptide variant
FYKMLKRLFKFFNCAIPIIRMRSVRYLADAAALKGAALAANGRKAKKLELDYKKDAK

SEQ ID NO: 3661 - protein, 37 aa, Artificial Sequence
  Computer-generated peptide variant
RFKMWTRFLRRWKRAALPKKLLWLFRYAGARLNANMR

SEQ ID NO: 3662 - protein, 40 aa, Artificial Sequence
  Computer-generated peptide variant
RWRYLQRYFRLFKKFMQWANALKKKWQRKFLRKQLLLPFV

SEQ ID NO: 3663 - protein, 28 aa, Artificial Sequence
  Computer-generated peptide variant
KWKLMRKMYKRIHPLWLAGKALHFRLAP

SEQ ID NO: 3664 - protein, 33 aa, Artificial Sequence
  Computer-generated peptide variant
RLRYLNKWIRRIRRLLAMKRAALGKYATNRRLE

SEQ ID NO: 3665 - protein, 50 aa, Artificial Sequence
  Computer-generated peptide variant
KFRYLKKLLKKIRPLRLRAAANKGTFFMARRSLAQSAHASKPHWALAWEL

SEQ ID NO: 3666 - protein, 55 aa, Artificial Sequence
  Computer-generated peptide variant
LLRFLPRMWKWMRQAVRQAATKRMKLLARTAALARRDCPRRWKGERFESKRYAAI

SEQ ID NO: 3667 - protein, 28 aa, Artificial Sequence
  Computer-generated peptide variant
LLRYFTRLLRKLQKKERSHICASQAAPK

SEQ ID NO: 3668 - protein, 40 aa, Artificial Sequence
  Computer-generated peptide variant
RFRLLQKLMRLFRRKKAPPLKGGLNTKEAVLRIRNAELEC

SEQ ID NO: 3669 - protein, 45 aa, Artificial Sequence
  Computer-generated peptide variant
LWRFIRKLFRILKPMRRLSARREKFLHNALYIFRSRGMAWYLRAK

SEQ ID NO: 3670 - protein, 63 aa, Artificial Sequence
  Computer-generated peptide variant
RLKFLHKIWRKLQRHMRAQRAKHLRMPAKGHLKKGSLGNLRPARPLMAHLSKRRFHDYMKAPR

SEQ ID NO: 3671 - protein, 36 aa, Artificial Sequence
  Computer-generated peptide variant
RYKFFQKILRLLNKIGEAAYANIYDRKAMRALRAKC

SEQ ID NO: 3672 - protein, 25 aa, Artificial Sequence
  Computer-generated peptide variant
LWKLFRRWWRWLKTSKAAYLFKDRA

SEQ ID NO: 3673 - protein, 27 aa, Artificial Sequence
  Computer-generated peptide variant
KLRLLHKYLKRFSTKERANEQNKARFL

SEQ ID NO: 3674 - protein, 25 aa, Artificial Sequence
  Computer-generated peptide variant
WFRYFRRLLRKLKRNMRVAATALSF

SEQ ID NO: 3675 - protein, 55 aa, Artificial Sequence
  Computer-generated peptide variant
LFKIMRRIMRKYRPRLKYVLEEAWLLWCKQEKHRWLGMLLALMFKRRRPRARRAQ

SEQ ID NO: 3676 - protein, 30 aa, Artificial Sequence
  Computer-generated peptide variant
RYKMLSKILRKWTKLFAEAWRLRMFRELLA

SEQ ID NO: 3677 - protein, 23 aa, Artificial Sequence
  Computer-generated peptide variant
KLKLMKKYFKLLCQQIARTYSAL

SEQ ID NO: 3678 - protein, 22 aa, Artificial Sequence
  Computer-generated peptide variant
KLKFWCRLYKMYRRARPWLKAA

SEQ ID NO: 3679 - protein, 45 aa, Artificial Sequence
  Computer-generated peptide variant
KLKILKRLLRKYSSAAWAQFRNANNAKQLKHDRSPALSYKCGRMR

SEQ ID NO: 3680 - protein, 30 aa, Artificial Sequence
  Computer-generated peptide variant
KLRYIRRFLKLFRKIAAPVAKICNKARCMA

SEQ ID NO: 3681 - protein, 24 aa, Artificial Sequence
  Computer-generated peptide variant
RIKLWRRFLRFLTKYLCKKLAALA

SEQ ID NO: 3682 - protein, 45 aa, Artificial Sequence
  Computer-generated peptide variant
KFKLWRKLLKFWPTVDRLARHKHAFLERGKFFYSIDRRMLLRLLR

SEQ ID NO: 3683 - protein, 25 aa, Artificial Sequence
  Computer-generated peptide variant
KLKFFHRLLRRLRCIADKFWATVLP

SEQ ID NO: 3684 - protein, 27 aa, Artificial Sequence
  Computer-generated peptide variant
ILRYFRKLLRIFKKMPALSERHYLLEK

SEQ ID NO: 3685 - protein, 64 aa, Artificial Sequence
  Computer-generated peptide variant
MLKWYNRLMRLMHRLRAKAHARKMVKRRAMHERKLKWKAKPDWASRADKFGLAACKKYTLIVKS

SEQ ID NO: 3686 - protein, 38 aa, Artificial Sequence
  Computer-generated peptide variant
KIKLYTKFFKILRRMLFLLEKSTTKMAKKLAYANSLAR

SEQ ID NO: 3687 - protein, 29 aa, Artificial Sequence
  Computer-generated peptide variant
LWRMLKRLFKKFKKMANAQALRSKLRHSF

SEQ ID NO: 3688 - protein, 22 aa, Artificial Sequence
  Computer-generated peptide variant
RFRWLRKFFRRLNRLAMRRLAA

SEQ ID NO: 3689 - protein, 30 aa, Artificial Sequence
  Computer-generated peptide variant
RFRILRKMYRILSKLLTKLTGDRLCGLIRK

SEQ ID NO: 3690 - protein, 27 aa, Artificial Sequence
  Computer-generated peptide variant
ILRLFNRLFKLWKNRRARLDLLHSCQW

SEQ ID NO: 3691 - protein, 63 aa, Artificial Sequence
  Computer-generated peptide variant
KIRWIPKLIKYLCKAQKDKRTGILKRAEGRSRHVCDALLQKRGMAKQAKLAALWWARAKPIEK

SEQ ID NO: 3692 - protein, 25 aa, Artificial Sequence
  Computer-generated peptide variant
RIRLLRRFMRKLTRAVRLATTLRAN

SEQ ID NO: 3693 - protein, 42 aa, Artificial Sequence
  Computer-generated peptide variant
YMKLYRRLIKRIQKERQLRLMHQGAKRNALSAKAQGALRKWE

SEQ ID NO: 3694 - protein, 34 aa, Artificial Sequence
  Computer-generated peptide variant
KLKMLKKLLKYFTTLIYKRRTAAYNMAANHELLW

SEQ ID NO: 3695 - protein, 29 aa, Artificial Sequence
  Computer-generated peptide variant
KLRILSRLIRRWTQKYRVAQALSAFAWFA

SEQ ID NO: 3696 - protein, 60 aa, Artificial Sequence
  Computer-generated peptide variant
LFRWFKKMLRRWRRVLIARAPALSGRRYFRPMKKRHTQAMHKRLLQNKEKLAASANWDLR

SEQ ID NO: 3697 - protein, 36 aa, Artificial Sequence
  Computer-generated peptide variant
FYKFLNKLLKLLRRKAKGYTGATQAWKASAWASILK

SEQ ID NO: 3698 - protein, 21 aa, Artificial Sequence
  Computer-generated peptide variant
KLRLFNRFFRYLNRLARRLNK

SEQ ID NO: 3699 - protein, 28 aa, Artificial Sequence
  Computer-generated peptide variant
KIKFLKKLFRFIKSFRLFYEARKMHAAA

SEQ ID NO: 3700 - protein, 30 aa, Artificial Sequence
  Computer-generated peptide variant
FLRFMRRLIRRYKSARLALSTRYLAETHVK

SEQ ID NO: 3701 - protein, 30 aa, Artificial Sequence
  Computer-generated peptide variant
ILKYFHKFIKKLKKWALALRKKFRAQLALQ

SEQ ID NO: 3702 - protein, 38 aa, Artificial Sequence
  Computer-generated peptide variant
RLRFLPRLLKRMTKSWCPARRLTRTAHATELALALDRP

SEQ ID NO: 3703 - protein, 70 aa, Artificial Sequence
  Computer-generated peptide variant
RIKLLRKLFKKFNTRLRLWLQCRKSLAKKLSWLRCAKVKRQARLFALPCVYDKESREEIMPLAMAVKYGK

SEQ ID NO: 3704 - protein, 75 aa, Artificial Sequence
  Computer-generated peptide variant
KIRMYRKFLRKYRPYVIAARFYAALYILLSLRDLTALALRAMLTATKENRWRRALLFDYRIYFFLKPEAKLLRLR

SEQ ID NO: 3705 - protein, 61 aa, Artificial Sequence
  Computer-generated peptide variant
YFKWLQKYYKKLCKRLLLAAKWLKDDHAALHGRRKLKRKWYWILHELAYLRMKRTILGARI

SEQ ID NO: 3706 - protein, 34 aa, Artificial Sequence
  Computer-generated peptide variant
RLKLLKKILKKFRQCVLAIPDLRKQWFIRCATGK

SEQ ID NO: 3707 - protein, 21 aa, Artificial Sequence
  Computer-generated peptide variant
LLRIINRLWRRLRQARTAWFP

SEQ ID NO: 3708 - protein, 38 aa, Artificial Sequence
  Computer-generated peptide variant
LLRFWQKLIRRLKKSAEQKLCYNAWRCALLFTKEKSKN

SEQ ID NO: 3709 - protein, 78 aa, Artificial Sequence
  Computer-generated peptide variant
FLRILRRILKFLNRAKWALRLMWHRSAAKTFRYPKNRRGNKLFQGLEMKAKWGAPRRKARMDAKDIRASRAAHCFLAV

SEQ ID NO: 3710 - protein, 21 aa, Artificial Sequence
  Computer-generated peptide variant
FMRLFRRWMKFLSKLSARAVA

SEQ ID NO: 3711 - protein, 26 aa, Artificial Sequence
  Computer-generated peptide variant
KMKILSKLLRRFSRIRRFNEAAAAWS

SEQ ID NO: 3712 - protein, 27 aa, Artificial Sequence
  Computer-generated peptide variant
RLKWIRKMFKKLCRAADNRKGLYAIAM

SEQ ID NO: 3713 - protein, 23 aa, Artificial Sequence
  Computer-generated peptide variant
YFRLLCKIWKKLQKAQKRYAILD

SEQ ID NO: 3714 - protein, 22 aa, Artificial Sequence
  Computer-generated peptide variant
KLRLLKKFWKMLRKLYAKANQA

SEQ ID NO: 3715 - protein, 64 aa, Artificial Sequence
  Computer-generated peptide variant
MWKLFRKILRRIKCAFATLRRRKSAMEAASAPRNLFQSAYHEPTARCAGPKLMRWALLRLIKRL

SEQ ID NO: 3716 - protein, 77 aa, Artificial Sequence
  Computer-generated peptide variant
KYKLLRRIFKLWRRPKKWILRRMRWKLIAMHKGLLAKQLWLMMGENRYLASEGHAAILPASKKANLLRYENLRHLLQ

SEQ ID NO: 3717 - protein, 77 aa, Artificial Sequence
  Computer-generated peptide variant
LLRLLTKMFRRLKHQAIKLLVLMNMECKTIGRVVKKKLKRKILCLMTAELRLFAGKEFKYKYPFAKALWRKEAGLRF

SEQ ID NO: 3718 - protein, 37 aa, Artificial Sequence
  Computer-generated peptide variant
YLKFWRKIFRLWPKMLKKRKRLHALKAGWTLWSLYKA

SEQ ID NO: 3719 - protein, 23 aa, Artificial Sequence
  Computer-generated peptide variant
RLKIFRRWWRWYRHRASAGLHLA

SEQ ID NO: 3720 - protein, 56 aa, Artificial Sequence
  Computer-generated peptide variant
LMRIFRKFLRKLRKQKALKGLRRWLYAMEKFAFRQAMMGKMKRELLDYLTLHGYGK

SEQ ID NO: 3721 - protein, 32 aa, Artificial Sequence
  Computer-generated peptide variant
ILKWWKKLIKWIKTLRKHLVRCHYADRKLADA

SEQ ID NO: 3722 - protein, 23 aa, Artificial Sequence
  Computer-generated peptide variant
RMKFLNRLLRLIPKCLHAWLNRC

SEQ ID NO: 3723 - protein, 27 aa, Artificial Sequence
  Computer-generated peptide variant
RLRLYNRYYRKIRTRRSAQLAAKQEIL

SEQ ID NO: 3724 - protein, 38 aa, Artificial Sequence
  Computer-generated peptide variant
KWKYLRRFFRKFSPRSKLYGKRALKLKAPCDAKLALEC

SEQ ID NO: 3725 - protein, 46 aa, Artificial Sequence
  Computer-generated peptide variant
KYRFLRKYWRRLHPLTKRLMFELQQRACLCAKKCLVANKALHRRQG

SEQ ID NO: 3726 - protein, 53 aa, Artificial Sequence
  Computer-generated peptide variant
RLKLLRRLLRKLKTNPHWYLKKRWQYPHRKSFVFLATKSLRPRRKTAKALLAK

SEQ ID NO: 3727 - protein, 44 aa, Artificial Sequence
  Computer-generated peptide variant
LWRLYPKLLRRMKRWAANHKAALWAYPKPCAELPMPVSRRDKAA

SEQ ID NO: 3728 - protein, 23 aa, Artificial Sequence
  Computer-generated peptide variant
LFKLWTRFLRKFQRLAAHRCAFM

SEQ ID NO: 3729 - protein, 21 aa, Artificial Sequence
  Computer-generated peptide variant
LLKLMRRILKRMNKGRISTAF

SEQ ID NO: 3730 - protein, 23 aa, Artificial Sequence
  Computer-generated peptide variant
YLRIFKKMIKLYTKLANKQLKLD

SEQ ID NO: 3731 - protein, 44 aa, Artificial Sequence
  Computer-generated peptide variant
FLKMLQKLLKRLRRERIIWVGASALLWRIDAFGRLAKHGTKRLL

SEQ ID NO: 3732 - protein, 56 aa, Artificial Sequence
  Computer-generated peptide variant
LIRLLQKWMRKLKHRYKYAKELRLKKLPEAGWNKALWMTIALHRGKSITAKQDKEL

SEQ ID NO: 3733 - protein, 35 aa, Artificial Sequence
  Computer-generated peptide variant
LWRLLKRLLRFMKCCRLDKAKALKRASQGRFKEKI

SEQ ID NO: 3734 - protein, 22 aa, Artificial Sequence
  Computer-generated peptide variant
LFKFLCKYMKRLHKYKLTLKLF

SEQ ID NO: 3735 - protein, 57 aa, Artificial Sequence
  Computer-generated peptide variant
KFRLLRRMLRLFRKAAGNIRDRYKNSLIPKNAKCRRESNEDCRCLLLAKLRYALFRA

SEQ ID NO: 3736 - protein, 23 aa, Artificial Sequence
  Computer-generated peptide variant
KLKIWRRLLRWIRQAFWRALGAT

SEQ ID NO: 3737 - protein, 20 aa, Artificial Sequence
  Computer-generated peptide variant
LMKFFKRFLRYIKRARAALM

SEQ ID NO: 3738 - protein, 36 aa, Artificial Sequence
  Computer-generated peptide variant
YLRLLTKIYRRICRKRKRLAGKLKPLGAMMHLKALL

SEQ ID NO: 3739 - protein, 52 aa, Artificial Sequence
  Computer-generated peptide variant
LLKLWHRLLRKFKKKLIRLDRRHAAARLDKLAKKKRDWWHLLAKRTKPIKKD

SEQ ID NO: 3740 - protein, 61 aa, Artificial Sequence
  Computer-generated peptide variant
RLRYWKKFLKKLKRRALTRAKARRVREHNYFPAKKTLPKEYTLSTRNALLMMRKLLALGFN

SEQ ID NO: 3741 - protein, 58 aa, Artificial Sequence
  Computer-generated peptide variant
FLKLWCRFIRRYRKLEENRALPLSTTKAKQSRYAKEKARPKDAKWAYFVKNKLATYAA

SEQ ID NO: 3742 - protein, 96 aa, Artificial Sequence
  Computer-generated peptide variant
RFRFIKRMLKLLRKKRKLELMLKVDCKAKKSKCKRMAAAVHALGRPAERCAGTSLQLRKRKWAWRPAVLKAKRRKRKMADRLYHEPPLNARRLLNE

SEQ ID NO: 3743 - protein, 28 aa, Artificial Sequence
  Computer-generated peptide variant
LMKFLHRLIRRLKKMRGGAQIAPLADAQ

SEQ ID NO: 3744 - protein, 69 aa, Artificial Sequence
  Computer-generated peptide variant
KLRFLKKFLRWLKKSRLLAAELNANLSKDKMGAKLFKGRLGCKNRAKIKGYVRMNGKLAKKGQQYAKCE

SEQ ID NO: 3745 - protein, 57 aa, Artificial Sequence
  Computer-generated peptide variant
RFRLLPKILRKFKQFRYKMRALRRRLCCKHLARRWALLVDKTALRGAWMFKIQLKVK

SEQ ID NO: 3746 - protein, 27 aa, Artificial Sequence
  Computer-generated peptide variant
WLKLLNRMFKRLRRGLSLRALNRLPNI

SEQ ID NO: 3747 - protein, 58 aa, Artificial Sequence
  Computer-generated peptide variant
RFKLLQRWFKRWKRLCAKARATPSAVARLITCAVISLALREVELRALRMRHKLCFRWL

SEQ ID NO: 3748 - protein, 34 aa, Artificial Sequence
  Computer-generated peptide variant
YMKLLRRYLRRIKKAHALLPRMLKRHMALEARAI

SEQ ID NO: 3749 - protein, 25 aa, Artificial Sequence
  Computer-generated peptide variant
RLKIMKRMLRRYQRLQRWAMQWLLF

SEQ ID NO: 3750 - protein, 30 aa, Artificial Sequence
  Computer-generated peptide variant
KLKLLQKIWKLYRRHGKGAIAKMRKIVAYH

SEQ ID NO: 3751 - protein, 26 aa, Artificial Sequence
  Computer-generated peptide variant
KWKIFKKFLRRLKKLFKLPCLNLTLL

SEQ ID NO: 3752 - protein, 54 aa, Artificial Sequence
  Computer-generated peptide variant
RLRMWRRYLKKYKRQKHAWEIKRALRHKRLSVPLLRNARNALERTALLKYWHRY

SEQ ID NO: 3753 - protein, 45 aa, Artificial Sequence
  Computer-generated peptide variant
FLRLLRKLYKWFNRILKMSLGRTIQAARRAAAKASYQSMLALRPK

SEQ ID NO: 3754 - protein, 20 aa, Artificial Sequence
  Computer-generated peptide variant
LIRMIQRWLKKFRSAAAVAM

SEQ ID NO: 3755 - protein, 22 aa, Artificial Sequence
  Computer-generated peptide variant
YIKLFCRLLKRLRKELLSTALW

SEQ ID NO: 3756 - protein, 29 aa, Artificial Sequence
  Computer-generated peptide variant
MMKFLKRWLRKWTRALQRKAAQLHCRSML

SEQ ID NO: 3757 - protein, 64 aa, Artificial Sequence
  Computer-generated peptide variant
KIRLLHRLYRKMCPPLCRKKKLREAKLRQKLARLSLQKSFLLILLTGYALACDACNSFYDKGDR

SEQ ID NO: 3758 - protein, 58 aa, Artificial Sequence
  Computer-generated peptide variant
LLKFITKLLKKLNSLARRRIWPCRKYTTYGHQLNARAILRAEARDLVTDDKLKVRRAE

SEQ ID NO: 3759 - protein, 43 aa, Artificial Sequence
  Computer-generated peptide variant
RFRLFKKLLKILRQETGLLLRRLVHFLANDAYKYFRVQVWLKL

SEQ ID NO: 3760 - protein, 36 aa, Artificial Sequence
  Computer-generated peptide variant
RWKFFKRWLRRFKNAACVAVRTPLMMVKAKNRLLLK

SEQ ID NO: 3761 - protein, 69 aa, Artificial Sequence
  Computer-generated peptide variant
KFKFFRKFMKLLNRKRRRCCFWSDFLKLLFLKMIGLRRAKNLLAYCLRKGWAARRLRRFDSYQNLKSWQ

SEQ ID NO: 3762 - protein, 37 aa, Artificial Sequence
  Computer-generated peptide variant
LFKFLRRLLRKLCRHCIKKKRHRADWWKAAAWKNPHL

SEQ ID NO: 3763 - protein, 21 aa, Artificial Sequence
  Computer-generated peptide variant
RIRLLHRWIKFLHQRGLKYLL

SEQ ID NO: 3764 - protein, 24 aa, Artificial Sequence
  Computer-generated peptide variant
LYRFMHRLIRRFPKKTKANCLLAL

SEQ ID NO: 3765 - protein, 32 aa, Artificial Sequence
  Computer-generated peptide variant
KLKLLSRLLKFFKRARRKALRLTPKPRPGDIL

SEQ ID NO: 3766 - protein, 46 aa, Artificial Sequence
  Computer-generated peptide variant
KLKLFRRFLRFLKRWRAQRFCLRKAGWNRPLKIAPSYKSLKAKHNA

SEQ ID NO: 3767 - protein, 21 aa, Artificial Sequence
  Computer-generated peptide variant
IIRWLKKYFKKLKRTAALVLR

SEQ ID NO: 3768 - protein, 61 aa, Artificial Sequence
  Computer-generated peptide variant
MWRYLKRWLRKIKQASKKACVATWKDYYFRLLDGIARKRKFSVKLALGSAAVPRLLKKKVL

SEQ ID NO: 3769 - protein, 60 aa, Artificial Sequence
  Computer-generated peptide variant
FIRLMRRFYRKLHRKEMQLVPNARLYRRFLKKHRLKTGAHAAMKSLCAVMEWKARLDKAL

SEQ ID NO: 3770 - protein, 80 aa, Artificial Sequence
  Computer-generated peptide variant
RLRLIKRLLKFFQPAIYARILKPYMFWRRCWFLSLATKAALFNGNKSLKANDLKKWKRYLKKAVCLAHKLQKAYAIEAWA

SEQ ID NO: 3771 - protein, 32 aa, Artificial Sequence
  Computer-generated peptide variant
FMRLFKRLLRFWRRNLTAILCKMALRPRSLHL

SEQ ID NO: 3772 - protein, 47 aa, Artificial Sequence
  Computer-generated peptide variant
KWRMMQRYLKKYKKAWLLQGNLADRKLAVALPQKAKNADRWDCGRVR

SEQ ID NO: 3773 - protein, 97 aa, Artificial Sequence
  Computer-generated peptide variant
MIKYFRRLLKKIRKHKTKRVLELRHALMTHENKLTFLYMHLKKQQVTYHQAFIKRKAAPPKLKLKLGAKKPIPKKLARLRTRALRNPKLRLPWGHSA

SEQ ID NO: 3774 - protein, 21 aa, Artificial Sequence
  Computer-generated peptide variant
WLRLIKRIFRFLRRRDLLYAD

SEQ ID NO: 3775 - protein, 75 aa, Artificial Sequence
  Computer-generated peptide variant
RLRYWRRLLRMLCSLWKLRLSTVVMALKRERRKVANRLLSEALERLCKYEDKRQAKHLSKLPMHKAQKMLKRQNL

SEQ ID NO: 3776 - protein, 45 aa, Artificial Sequence
  Computer-generated peptide variant
LLKLFKRLMRFFRKKASNRWKCWTNRQAFGWLMRYKLHALLKTRY

SEQ ID NO: 3777 - protein, 36 aa, Artificial Sequence
  Computer-generated peptide variant
IYRYLKRILKYFKCNAHPRTIRKALMSLSRAAAYAA

SEQ ID NO: 3778 - protein, 23 aa, Artificial Sequence
  Computer-generated peptide variant
KIRLFKKYLRFLQRDANVVLARD

SEQ ID NO: 3779 - protein, 26 aa, Artificial Sequence
  Computer-generated peptide variant
KFKFIRRMFKLMKNRLYLPAKATLAA

SEQ ID NO: 3780 - protein, 52 aa, Artificial Sequence
  Computer-generated peptide variant
KFRLFRKIMKRMRRLARTKPHLAALKMEDRLAVRVRKMQKCYLLLQDRMPIV

SEQ ID NO: 3781 - protein, 77 aa, Artificial Sequence
  Computer-generated peptide variant
LYKFFNRWWRILKSKLRMTRRQACAVALIMTAWEQLIHKKAAFKLRPKVDLAYMAYAWAAFARLNRKMASRLNRRAR

SEQ ID NO: 3782 - protein, 29 aa, Artificial Sequence
  Computer-generated peptide variant
LWKLWKRLYRLLQSNCCPNKRVLYRKLKA

SEQ ID NO: 3783 - protein, 52 aa, Artificial Sequence
  Computer-generated peptide variant
MIRLFKKLLKMYKNKEAAAKDRYKRASRAEGASALHAMLCCKLRKQALKWRA

SEQ ID NO: 3784 - protein, 32 aa, Artificial Sequence
  Computer-generated peptide variant
LLKFFRKFLKRFKPDRRTQRKFHLDIFLSLLL

SEQ ID NO: 3785 - protein, 73 aa, Artificial Sequence
  Computer-generated peptide variant
RIRLLKRFLRRLNRYALVDAVDLMAEKAKAALTLKAMDLKRFPAVLSPFAYSRQLKFKSSIKMINKAAKEISL

SEQ ID NO: 3786 - protein, 77 aa, Artificial Sequence
  Computer-generated peptide variant
KLKYLRKFLKRMSHKRRFGKMAGGGQALDAMKAGKAVLVKSACIRALWDKCASRKGAACLKAFRKKRLQREIIKILH

SEQ ID NO: 3787 - protein, 49 aa, Artificial Sequence
  Computer-generated peptide variant
WIKILKRFLRKMNKLPRLCKTGKMKKALLKYNCAYLKSQLGLASYRAAI

SEQ ID NO: 3788 - protein, 95 aa, Artificial Sequence
  Computer-generated peptide variant
LFKFFRRMMRKYQRRTKSAACQATLKKRVYKKRLLKLGTTNAQEHKWALSHRAALMSAPHTNWARKFACKKKGLLKMKRAEATLRARWMDFQLKK

SEQ ID NO: 3789 - protein, 61 aa, Artificial Sequence
  Computer-generated peptide variant
RWRWYKRIWRWLKKRVRRMLLAASSQAAIFLLYALVYPRRRKNLCLWLAKSRKDMLRKKRY

SEQ ID NO: 3790 - protein, 83 aa, Artificial Sequence
  Computer-generated peptide variant
RIRYWKKFMRKMNKSALQQRARILDACCRLKPETAEDRALIRQWATYPLWRYLSARRLRKLCKNLRARDARKKTLIRTKNLNT

SEQ ID NO: 3791 - protein, 55 aa, Artificial Sequence
  Computer-generated peptide variant
KMRLIQKWLKRLCRWWLVILKRLTLQRAAAKLLKIADCYLAVKLSSKDYRDGKLI

SEQ ID NO: 3792 - protein, 39 aa, Artificial Sequence
  Computer-generated peptide variant
ILKLWRKMIKRLRKRRKQRAFLKLRALLELRANMAVSHG

SEQ ID NO: 3793 - protein, 27 aa, Artificial Sequence
  Computer-generated peptide variant
LLRFLKKIFKFLPTANIDRFIKKMALR

SEQ ID NO: 3794 - protein, 40 aa, Artificial Sequence
  Computer-generated peptide variant
RFKLFHRLLKRLPREQRGRVKHRNRLTSSQHLANRAYYLK

SEQ ID NO: 3795 - protein, 36 aa, Artificial Sequence
  Computer-generated peptide variant
LFKWFRRLLKFIKRLAADNRAGYQKVARSTKKVRCA

SEQ ID NO: 3796 - protein, 47 aa, Artificial Sequence
  Computer-generated peptide variant
RLKIIRRMLKRLRPKLWKGKVRMSRMWIKLGAVLLLPKEAEWLLLAH

SEQ ID NO: 3797 - protein, 37 aa, Artificial Sequence
  Computer-generated peptide variant
LMRWIKRLLKFLRKKRKSMGLRAYVEKALQQKGLVLQ

SEQ ID NO: 3798 - protein, 84 aa, Artificial Sequence
  Computer-generated peptide variant
LLRWLRKLYRWIKTSLRKRRTRSSYRELATVGECALFAARVKAAILDRIRRSDIAVEIQASAFCEYNRAAPKWLCLARLKKLAL

SEQ ID NO: 3799 - protein, 34 aa, Artificial Sequence
  Computer-generated peptide variant
RYRWLRRFFRKLPPGLKRGLDEAAARIKANQRHT

SEQ ID NO: 3800 - protein, 93 aa, Artificial Sequence
  Computer-generated peptide variant
IIRLLRKFWKRMKTDARALRASLYHNRNDLQLRAALLAFLATRKRERKLGNATPRVLLHPRGNCRLLMSQFKSANCLKRALKIQMPLRREVAK

SEQ ID NO: 3801 - protein, 61 aa, Artificial Sequence
  Computer-generated peptide variant
KLRLIKKLFKRFQKGKVALMKWATWATAAFRMYCHLLNTARWRWKTLARWEKLIPIKYRRR

SEQ ID NO: 3802 - protein, 70 aa, Artificial Sequence
  Computer-generated peptide variant
KYKFIPRFWRYWKKVPGARNELKYKKFMLAKVRKKLRKRPLLAIMRTARAASRWPFNADLLNAKPWRARP

SEQ ID NO: 3803 - protein, 73 aa, Artificial Sequence
  Computer-generated peptide variant
RIKYMRRWLKFMHRKYAKVNGKLKKEFDRQWCRKALNAFAYLKRPVLEFELRPWRRQAMLARKKAYAQRARLA

SEQ ID NO: 3804 - protein, 26 aa, Artificial Sequence
  Computer-generated peptide variant
RYRLFHRLLKIYKRLMLWASAIKALR

SEQ ID NO: 3805 - protein, 40 aa, Artificial Sequence
  Computer-generated peptide variant
KIRILPKLWRFLPKRLANQRKRWNALWRMLNLYQALNYLQ

SEQ ID NO: 3806 - protein, 35 aa, Artificial Sequence
  Computer-generated peptide variant
KLRMFTRFLRLYHKWARKVYKNADLDGADRRAKLR

SEQ ID NO: 3807 - protein, 43 aa, Artificial Sequence
  Computer-generated peptide variant
LLKLLRKLMKKFQRKEQHEARAVGWLLAKYLTRREFRPRPWKW

SEQ ID NO: 3808 - protein, 21 aa, Artificial Sequence
  Computer-generated peptide variant
RLRYMRRWWRLLRHLVDLWPA

SEQ ID NO: 3809 - protein, 29 aa, Artificial Sequence
  Computer-generated peptide variant
KWKLWPKLYKMLRRLHAKEKLLFLGRCLM

SEQ ID NO: 3810 - protein, 40 aa, Artificial Sequence
  Computer-generated peptide variant
MWRLFKKLFKYFRTGLARLAALLKLDCALELCTDHIKIYK

SEQ ID NO: 3811 - protein, 22 aa, Artificial Sequence
  Computer-generated peptide variant
RLKWYPRLLRLLNNKARYDQAI

SEQ ID NO: 3812 - protein, 91 aa, Artificial Sequence
  Computer-generated peptide variant
KFRYYSKFWKRIRTKWEKSKETLCYRRAKRFHRNYAAKQRKLAEPVLRVLALLQRKLRKLILYLLDRRRKLLSARKIRRQLAEDQKQWAWL

SEQ ID NO: 3813 - protein, 82 aa, Artificial Sequence
  Computer-generated peptide variant
MLRFICRFIKRMRPVKLLFTPCLRAVEAAANRNLALRAKFRRLARQVAANLFRGRLRDWYNKLGRYLVLASKLIQRPSLLML

SEQ ID NO: 3814 - protein, 60 aa, Artificial Sequence
  Computer-generated peptide variant
RLKLMSKWIKRLRKLPWCRGYARLKLFVQYLAFKEWRRHYYARRFAAAGTAKWTLLLFKS

SEQ ID NO: 3815 - protein, 95 aa, Artificial Sequence
  Computer-generated peptide variant
RIKLLRRILKFINRRQHKARRAKTDKDRACVKWAVAKKYLAQAARCARQKAAEMLCLGLLACTYKWVARLFVDDKALLWYYHILVGASLRRKILK

SEQ ID NO: 3816 - protein, 45 aa, Artificial Sequence
  Computer-generated peptide variant
YFRIMQKYLKKFKCYRRARTMKKHAKLKTFGLKAALYCSKTLRLA

SEQ ID NO: 3817 - protein, 28 aa, Artificial Sequence
  Computer-generated peptide variant
RLRLFTRLLRKMQRYCKADLKLAARDCQ

SEQ ID NO: 3818 - protein, 21 aa, Artificial Sequence
  Computer-generated peptide variant
KLKLISKWLKRWKRALQYLYC

SEQ ID NO: 3819 - protein, 20 aa, Artificial Sequence
  Computer-generated peptide variant
RLKFFNKLLRKIRKLWAAVV

SEQ ID NO: 3820 - protein, 24 aa, Artificial Sequence
  Computer-generated peptide variant
LFRLWKRWLRKLKKVRLYALHASK

SEQ ID NO: 3821 - protein, 45 aa, Artificial Sequence
  Computer-generated peptide variant
MLRLIRRLWKIFCRRKKFFTTLRLAPMRAKEMTLLAFLKAEQLMK

SEQ ID NO: 3822 - protein, 24 aa, Artificial Sequence
  Computer-generated peptide variant
LFRLWRKLIRMLKPKALQKTTHKI

SEQ ID NO: 3823 - protein, 38 aa, Artificial Sequence
  Computer-generated peptide variant
MYRLFTKWLKRYNPEKLVYKKKHLPALGMAELLLAGRL

SEQ ID NO: 3824 - protein, 56 aa, Artificial Sequence
  Computer-generated peptide variant
WLRLMTKLFRKYKKHRPKLLLRTLKQWLAAHIKLKAHYLFEARKKTYKLAKATRKH

SEQ ID NO: 3825 - protein, 95 aa, Artificial Sequence
  Computer-generated peptide variant
RLRMLSRMIRYLKRKALPYQMLRYRIRKRLELWGCFRAMGWNAKRVCKRLWKLALRMKNHKFAKYMKRPQLTAIRPSATPFNKRKLTLAAKAIKI

SEQ ID NO: 3826 - protein, 78 aa, Artificial Sequence
  Computer-generated peptide variant
RYRFYKRLFRKFKCLRCLDHVDYCYAMIAKKALLTRRLAYARSTRCALAIVKKRLLQMRRDSLRNKATDDMECKLKAE

SEQ ID NO: 3827 - protein, 22 aa, Artificial Sequence
  Computer-generated peptide variant
FLKYLKKLLRKFSNALAAKSRK

SEQ ID NO: 3828 - protein, 36 aa, Artificial Sequence
  Computer-generated peptide variant
YFRWFCKFIRRYQRAEVKNRAKLLLYLQLARVLRTL

SEQ ID NO: 3829 - protein, 40 aa, Artificial Sequence
  Computer-generated peptide variant
YWRLFTKLFRRLKHAAPAKKKRRAMRLKIFCRLERLDDAT

SEQ ID NO: 3830 - protein, 93 aa, Artificial Sequence
  Computer-generated peptide variant
KLKLYRRWYKRMKKALKPAHVAIEARRKWRLSKRRLRYDYNAASAAYMKARSAEAALPKKSTAEKCALWKMERLWPLFLRRLLTAYNKLGNDK

SEQ ID NO: 3831 - protein, 47 aa, Artificial Sequence
  Computer-generated peptide variant
IFKFMKRIYKRFPRALALLMGARRKWMNWNAALIRAGLLKKKWCWKR

SEQ ID NO: 3832 - protein, 37 aa, Artificial Sequence
  Computer-generated peptide variant
RLRLMPRLLKFLRKAEAFPKLKIKERLKCGPPTGAFK

SEQ ID NO: 3833 - protein, 56 aa, Artificial Sequence
  Computer-generated peptide variant
RLRLWKKLLRKISKRLHKIKWDSALPGAGKAWLRRRWKLKAYNLFRKKAAKHQKSL

SEQ ID NO: 3834 - protein, 37 aa, Artificial Sequence
  Computer-generated peptide variant
RLKMWRRLLRKLRQAKAAAAAQKKLANRRALQILSLK

SEQ ID NO: 3835 - protein, 24 aa, Artificial Sequence
  Computer-generated peptide variant
KIKFLQRWLRMYPRLALRYLRHAN

SEQ ID NO: 3836 - protein, 77 aa, Artificial Sequence
  Computer-generated peptide variant
RIRLWQKLMRKLKRAKPRNIRFIHHAAHAHCARNQQALTRNHKTLAIRLHRRKRYARRYAYYKLRRRATMKWALWKP

SEQ ID NO: 3837 - protein, 74 aa, Artificial Sequence
  Computer-generated peptide variant
KFRMFKKFFRRLCHKRRALALSCQKKRLLKHAYQCICFWERWNALAELQPTAKLNLLRLRKRIALSVENLRPLR

SEQ ID NO: 3838 - protein, 35 aa, Artificial Sequence
  Computer-generated peptide variant
RLRMIKRLLKKFKNLVEIVQIDLARLWQVKRAAAW

SEQ ID NO: 3839 - protein, 20 aa, Artificial Sequence
  Computer-generated peptide variant
KIRFFRRYLRLLRNILFTAR

SEQ ID NO: 3840 - protein, 56 aa, Artificial Sequence
  Computer-generated peptide variant
KLRLLKRFIKKLKHRAAERSGFCIRARAQYRHKKLCRHPFVRDCVLIKLAIALTMC

SEQ ID NO: 3841 - protein, 67 aa, Artificial Sequence
  Computer-generated peptide variant
KMRLLRKFMRRIKRIFLRLRHKCQLALFDTANLLPRRQVQAAAMGTYKRLRACSAKQLRLCFYCKRK

SEQ ID NO: 3842 - protein, 69 aa, Artificial Sequence
  Computer-generated peptide variant
RLRIFCKLMRLWKRYVYDLARVRWRKYCLYRRRKCNRPETASYNALLLKQKKLKAQLPSCLLSLKLCAD

SEQ ID NO: 3843 - protein, 24 aa, Artificial Sequence
  Computer-generated peptide variant
YWKFLKRFYKLMPRRAAANQKKTL

SEQ ID NO: 3844 - protein, 72 aa, Artificial Sequence
  Computer-generated peptide variant
KWRFIRRLIKLLCCKKWRLQPILLLQGVKATKYKRPLELFKPSRALLRCRACAFLDEITRAVALGARCRKKF

SEQ ID NO: 3845 - protein, 54 aa, Artificial Sequence
  Computer-generated peptide variant
LWRLLQKWWKMFRNLRFLNVASRRRAFPQRKFFKLNRALLFAAANAVCWRARLY

SEQ ID NO: 3846 - protein, 30 aa, Artificial Sequence
  Computer-generated peptide variant
RFKLMKRIMKKLQRLYKNARKAYADMKAIL

SEQ ID NO: 3847 - protein, 32 aa, Artificial Sequence
  Computer-generated peptide variant
RFKFLNRYLKKMQPCLLGFNALKLKDAYADLR

SEQ ID NO: 3848 - protein, 23 aa, Artificial Sequence
  Computer-generated peptide variant
KLKYLPRWLRLMKRTLAVWCKGR

SEQ ID NO: 3849 - protein, 33 aa, Artificial Sequence
  Computer-generated peptide variant
MLKLICRLFKRLKSATDAGFLAAARLYGRKTPR

SEQ ID NO: 3850 - protein, 52 aa, Artificial Sequence
  Computer-generated peptide variant
YLKIIRKLMRRFQKKLRRKRAHAKLQVAAIAPHAKWKLLHQAERAMKKCTAW

SEQ ID NO: 3851 - protein, 37 aa, Artificial Sequence
  Computer-generated peptide variant
RMKLLRKFIRKLRKRRLIAQEGRALARKLDLAAMLYL

SEQ ID NO: 3852 - protein, 25 aa, Artificial Sequence
  Computer-generated peptide variant
FIRWLRRFLRLLRNCAYLHLTGAQR

SEQ ID NO: 3853 - protein, 91 aa, Artificial Sequence
  Computer-generated peptide variant
LMRLLKRYLKILTRRHGHNQLIKASRLWALANTIKACAITFRCLEWLKLIYEGALRALRQERRKARKRLKDYLGARGVFLACLGSLDRACW

SEQ ID NO: 3854 - protein, 31 aa, Artificial Sequence
  Computer-generated peptide variant
MIRMFNRLYKKLRKKLAVLRARKMAKCFEAQ

SEQ ID NO: 3855 - protein, 60 aa, Artificial Sequence
  Computer-generated peptide variant
RIRFLTKLFRRFRQKFLLWMLNKKKVIAKYKKAETHLEDAASIVKKTVLRLLSKLGLASW

SEQ ID NO: 3856 - protein, 37 aa, Artificial Sequence
  Computer-generated peptide variant
RLRLIPRFIRKLHNREHITFRRCAKDAYRNAKLATRA

SEQ ID NO: 3857 - protein, 47 aa, Artificial Sequence
  Computer-generated peptide variant
KLKWLRRWYRKFTHLATACKVLKGHTFRRDFALAPLKWKALKRGMLV

SEQ ID NO: 3858 - protein, 22 aa, Artificial Sequence
  Computer-generated peptide variant
KLRLWKKFLRLFNHKLIAKLRP

SEQ ID NO: 3859 - protein, 47 aa, Artificial Sequence
  Computer-generated peptide variant
ILRLMHKLLRMLTRFRFRAMQATKRRRKAQDCCKYAALGLNLWMLGL

SEQ ID NO: 3860 - protein, 70 aa, Artificial Sequence
  Computer-generated peptide variant
LWRMLKRILKLFRKAVALVWKGLRKALDLMKRKRSRPSAPRLFHENKLWLLRAHCAAWWFFRRYKKDVTG

SEQ ID NO: 3861 - protein, 25 aa, Artificial Sequence
  Computer-generated peptide variant
WLKWFCRFLRKMHRFAANFARAKLF

SEQ ID NO: 3862 - protein, 42 aa, Artificial Sequence
  Computer-generated peptide variant
MYRIMKKLMRMIKHLYGAKRLLAMKILLRFWRLPMYHRRARR

SEQ ID NO: 3863 - protein, 80 aa, Artificial Sequence
  Computer-generated peptide variant
KMRMLKRIWRKLRQFYAMGEGNDRCSKDGALLLDALLRATWKWVLSEKNAERASCRHRFNLALPKKRKKALLRIARNDRR

SEQ ID NO: 3864 - protein, 21 aa, Artificial Sequence
  Computer-generated peptide variant
LWKMYHKFLRILKKASVSKKA

SEQ ID NO: 3865 - protein, 49 aa, Artificial Sequence
  Computer-generated peptide variant
WLKLLSKWYRRLRRQRRHLFLRAAHDLVSGCDARLARDRDQSHVLMARA

SEQ ID NO: 3866 - protein, 94 aa, Artificial Sequence
  Computer-generated peptide variant
KLKMWHRFIKFLKKKADKLMPWMKKFKKAISAHEAWYYADLRLKKAHGKMIALALKCEQLEQLALDMYCDAATAKLANPKFRAARCLIILERLK

SEQ ID NO: 3867 - protein, 33 aa, Artificial Sequence
  Computer-generated peptide variant
RFRWLRRIWKLFKRALWFPKQKAKPKHRLLATA

SEQ ID NO: 3868 - protein, 24 aa, Artificial Sequence
  Computer-generated peptide variant
RFRLFTRWLKLFKPAAHLSLRAHM

SEQ ID NO: 3869 - protein, 42 aa, Artificial Sequence
  Computer-generated peptide variant
KLRMWRKMFKKFRNAMLKGLQKWMAKIFLKQKYRGLQAHLLR

SEQ ID NO: 3870 - protein, 43 aa, Artificial Sequence
  Computer-generated peptide variant
RWRLFKKFLKLLHKKTALILPRLAWFKECLMKAKWLRRKVRGT

SEQ ID NO: 3871 - protein, 41 aa, Artificial Sequence
  Computer-generated peptide variant
KYKWLHKYIRKFKKWRAHAKAPLRAELAGLRCGLKRIKCAT

SEQ ID NO: 3872 - protein, 28 aa, Artificial Sequence
  Computer-generated peptide variant
RMRMLRRFFRLLQRNDYKMAGRLRATYL

SEQ ID NO: 3873 - protein, 85 aa, Artificial Sequence
  Computer-generated peptide variant
KIRFITKWLRRFSRGRHRLKRISDFARANRKKILSAFLKRRKCLRYKFQNLTWADARPRPLVAGLRPDLLRRLRLERFHPARPAL

SEQ ID NO: 3874 - protein, 57 aa, Artificial Sequence
  Computer-generated peptide variant
YLRLLKRLMRKLRQQRRAKHLENFHAHRLWAAARLRFLLKHGRATQNLMPNAAYGGQ

SEQ ID NO: 3875 - protein, 38 aa, Artificial Sequence
  Computer-generated peptide variant
RLKMMRKLLRRMHKARPPHHAKAWWAQLKWIRILPCLL

SEQ ID NO: 3876 - protein, 40 aa, Artificial Sequence
  Computer-generated peptide variant
KWRWIKKIYKRIHSKWPPALLHAAIACNLGKRKAWNAKKK

SEQ ID NO: 3877 - protein, 38 aa, Artificial Sequence
  Computer-generated peptide variant
KMRLWQRLIKKWKTLAANHVLYKKLWVADRLRACYNAY

SEQ ID NO: 3878 - protein, 46 aa, Artificial Sequence
  Computer-generated peptide variant
MLKLFRKLMRFFSKTDLGKMKARARTKHLLLTKTSRALGVLAYMHL

SEQ ID NO: 3879 - protein, 25 aa, Artificial Sequence
  Computer-generated peptide variant
KLRLIKRWLRLIPKVKADWIMMQRA

SEQ ID NO: 3880 - protein, 31 aa, Artificial Sequence
  Computer-generated peptide variant
FLRILPRMMRKLRRVRRKAYEARLNALMFIF

SEQ ID NO: 3881 - protein, 34 aa, Artificial Sequence
  Computer-generated peptide variant
LYRLFKRLWKKFRRLALASILKPMPCLRAKNASS

SEQ ID NO: 3882 - protein, 91 aa, Artificial Sequence
  Computer-generated peptide variant
RMRFLRRMFKKYCQRRRLHNKRPWFKKVSERSAKPCLAWPMKAILHLKRKDLLLSLGRIGERLLATWALWRPEDKKKDKLKTKDLRDLRTA

SEQ ID NO: 3883 - protein, 34 aa, Artificial Sequence
  Computer-generated peptide variant
RLKYYKRFMKLYPSFIQTNRWLKKALRYKLLAKW

SEQ ID NO: 3884 - protein, 87 aa, Artificial Sequence
  Computer-generated peptide variant
LFKFLRRYYRRLRNYLMQAKLRDKCVKTLKRRCPSIQKCDGRAVRKLLLAAWVMLYFKALVSNLAYRKHLRHARLSLFVGNLHYALK

SEQ ID NO: 3885 - protein, 45 aa, Artificial Sequence
  Computer-generated peptide variant
RLRLFRRLWRMLQRADWPAPGARDLFKRQWHAAMSLKPAKLLKML

SEQ ID NO: 3886 - protein, 37 aa, Artificial Sequence
  Computer-generated peptide variant
RLRIYRRLMRRLRSVAELRTRLNLDAIKRKSMAYQIP

SEQ ID NO: 3887 - protein, 56 aa, Artificial Sequence
  Computer-generated peptide variant
FIRLWPKLLKKLRKLLSRKLKRLAAQAKYKKCNMTKNNLMPFADWHPRQIREHAFL

SEQ ID NO: 3888 - protein, 78 aa, Artificial Sequence
  Computer-generated peptide variant
KYRFWRKFLKLLPKLRRSEAWKALRRCKMLDRGRLITKCKAKAVEAAYIYCDKRACTVHPALPHDLVLMRLLTLVKWR

SEQ ID NO: 3889 - protein, 30 aa, Artificial Sequence
  Computer-generated peptide variant
LWRFLRKMYRKLPQLCAAKRYKRRFDLKSA

SEQ ID NO: 3890 - protein, 29 aa, Artificial Sequence
  Computer-generated peptide variant
KIKIYRRMFRYLQPAILKRAHLFNRAQAA

SEQ ID NO: 3891 - protein, 83 aa, Artificial Sequence
  Computer-generated peptide variant
RIRLMRKMIRRWRTAHCLSDMLQRARMAADAIAIHKHKQRQGQERLVRQAKLRCWHAKREKKAAPLEARKATGFYMRRALAGA

SEQ ID NO: 3892 - protein, 43 aa, Artificial Sequence
  Computer-generated peptide variant
KLKFIKRLFKRMKCLLLFRRIFVCLKAGQWLRMRAHYCKEFKA

SEQ ID NO: 3893 - protein, 26 aa, Artificial Sequence
  Computer-generated peptide variant
LLKFLSKFFRLIKKKKARKLANAWAN

SEQ ID NO: 3894 - protein, 32 aa, Artificial Sequence
  Computer-generated peptide variant
KWRFLTKFLKLLRNVKKRQTLLIKALLLRQRT

SEQ ID NO: 3895 - protein, 46 aa, Artificial Sequence
  Computer-generated peptide variant
MIRIWKRWLRLLKKRNRFKGSMAMAFRIDLKPLGLEAFKRLAKSRY

SEQ ID NO: 3896 - protein, 91 aa, Artificial Sequence
  Computer-generated peptide variant
MWKYFNRMMKLLRKAEAILAVKKKTIRQRSQLRKLLIKRPTLSARRRHKKMLRSMNKRMWIIKLLGPKAWKLRYGPVTVLLAAKKACANRK

SEQ ID NO: 3897 - protein, 47 aa, Artificial Sequence
  Computer-generated peptide variant
RLRIYQKFIRRYHRPCCLPWQAATRLQKRDKYLTEAIKRLLKLALKG

SEQ ID NO: 3898 - protein, 22 aa, Artificial Sequence
  Computer-generated peptide variant
FIRLLRKFLKRLRPIARAPHPG

SEQ ID NO: 3899 - protein, 42 aa, Artificial Sequence
  Computer-generated peptide variant
LWRFLCKWLKMMHKQRCRKVLDWKKCLARAMNRRAAFRARLL

SEQ ID NO: 3900 - protein, 81 aa, Artificial Sequence
  Computer-generated peptide variant
KWRLLRRLLRRWKRAVEKKERANNAIAIHFAAYAWRGRRMAYKYVRQVPVNLTLPKLAARLAAKLKRRQSCWKWELHIRAR

SEQ ID NO: 3901 - protein, 43 aa, Artificial Sequence
  Computer-generated peptide variant
KMRFFKRIYKFLKKPSFETDRVILRLRLRLAAKDLAAAARLNH

SEQ ID NO: 3902 - protein, 58 aa, Artificial Sequence
  Computer-generated peptide variant
KFRMLKKMWKKIKTSMCERGLNCAPRLCAYIHRKQANRYRPALRAMARASKALALDML

SEQ ID NO: 3903 - protein, 21 aa, Artificial Sequence
  Computer-generated peptide variant
LLKFLKKLLRKIKKCAFRLAS

SEQ ID NO: 3904 - protein, 32 aa, Artificial Sequence
  Computer-generated peptide variant
KFRILKRLLKRLKREMGPCWALRSHWVNALRN

SEQ ID NO: 3905 - protein, 81 aa, Artificial Sequence
  Computer-generated peptide variant
LLKWLKRFFKLFCRALARTLAMCWRWDFNFARLQHYQEARRTFVASKRIHYAKGLRRKRWKDIWAKLLREYKKLRIALKLK

SEQ ID NO: 3906 - protein, 87 aa, Artificial Sequence
  Computer-generated peptide variant
FFKYFKKLYRKIQKRRGRWKYLKRVAKLKRALQLLKVKRQYHVYDLVAQRRIAAKVLYVRSLLLKRDLFITCSGPLRIERQDKVLKA

SEQ ID NO: 3907 - protein, 44 aa, Artificial Sequence
  Computer-generated peptide variant
LLKLYPKLLKKYRKQHRRLIELKLALAIRSAAKLRWAFCCHICC

SEQ ID NO: 3908 - protein, 20 aa, Artificial Sequence
  Computer-generated peptide variant
RYRLLHRFWRKWRTLNAPVL

SEQ ID NO: 3909 - protein, 48 aa, Artificial Sequence
  Computer-generated peptide variant
IFKMLKKMLRLMPRLLRLPHARMAGWTTMKCRKCQGKRRRLLYKCALF

SEQ ID NO: 3910 - protein, 24 aa, Artificial Sequence
  Computer-generated peptide variant
KIKMWKKLLRRYHTAFSVLALRSL

SEQ ID NO: 3911 - protein, 22 aa, Artificial Sequence
  Computer-generated peptide variant
KFKLFRKMLKLLPKFAEKSKAA

SEQ ID NO: 3912 - protein, 72 aa, Artificial Sequence
  Computer-generated peptide variant
IWKFFKRFFKRLHNKYAKTNRLKLALGFPARLELKKLKALARGDHRMKHRAARPMKKFARRKAALDLCKMLR

SEQ ID NO: 3913 - protein, 60 aa, Artificial Sequence
  Computer-generated peptide variant
RLKFMTKLYRKLKKKQNFRAGWKCFKILLKDWQRAAIHLRGLRMSKRQRLSLRVLHRVTL

SEQ ID NO: 3914 - protein, 75 aa, Artificial Sequence
  Computer-generated peptide variant
FYRWLKKMLKIWRCHACLSARMNEKLLAQYDLKKKTTAKRVKKARKKHLSKLPARKQKAPPHMSLRYLAKCIHLR

SEQ ID NO: 3915 - protein, 41 aa, Artificial Sequence
  Computer-generated peptide variant
LWRLLRKWFRRLRPKKWRHNLMYALRACHMKGCREYLKARL

SEQ ID NO: 3916 - protein, 66 aa, Artificial Sequence
  Computer-generated peptide variant
RLKFMHRILKKLRSIQKLGPNACLELWLWIAALAARLRSNDKQRSLRRSPAMLERRAKHFKKRDLL

SEQ ID NO: 3917 - protein, 54 aa, Artificial Sequence
  Computer-generated peptide variant
KLKFLHKLLRRYKTQPAMKRDLCLTRRNHKANKNDAALEVAATCQVRLRLLILF

SEQ ID NO: 3918 - protein, 24 aa, Artificial Sequence
  Computer-generated peptide variant
RLRLMCRLWKLYRTLFARQMRNKL

SEQ ID NO: 3919 - protein, 36 aa, Artificial Sequence
  Computer-generated peptide variant
LLRLWRRIWRIIRKEALVRCAEPKLPLFLWAGLRTK

SEQ ID NO: 3920 - protein, 44 aa, Artificial Sequence
  Computer-generated peptide variant
WLRILRRFMKWLKRWAANRIVLEHIKRFRQLLAARAMWQRLVKE

SEQ ID NO: 3921 - protein, 20 aa, Artificial Sequence
  Computer-generated peptide variant
LFKLLKKFMKRMKNKWLAAL

SEQ ID NO: 3922 - protein, 34 aa, Artificial Sequence
  Computer-generated peptide variant
LLKYWNRLWRLLQKALCLDGLKRLRADRMLRCRS

SEQ ID NO: 3923 - protein, 85 aa, Artificial Sequence
  Computer-generated peptide variant
KYKFLSKYFKKWKQKLKADTATFMNRRVWERLKDTERLFAWYNEHARTKAALRDGAAAKKRACAKLLDKAVKREMANAVAMTAKI

SEQ ID NO: 3924 - protein, 43 aa, Artificial Sequence
  Computer-generated peptide variant
RLRWFKKLLKRFHKLLLLNAAYKAKLAYRDLNRAGRMANTSQV

SEQ ID NO: 3925 - protein, 53 aa, Artificial Sequence
  Computer-generated peptide variant
RLKLIRRMFKKYQRKWRGLRRLRTALPVLLRATVFRLKQLAPLKLPKAFRNKD

SEQ ID NO: 3926 - protein, 49 aa, Artificial Sequence
  Computer-generated peptide variant
MIKIYRRLLRKLRNLKDIKRNGTRSECASLRAAFLKRLGTFELLVPQRR

SEQ ID NO: 3927 - protein, 32 aa, Artificial Sequence
  Computer-generated peptide variant
RIKFLTKLYRLLNHVAKLGLKLMARRPNIRLV

SEQ ID NO: 3928 - protein, 23 aa, Artificial Sequence
  Computer-generated peptide variant
LYRMLKRYLKRLRRLWRTFAILY

SEQ ID NO: 3929 - protein, 44 aa, Artificial Sequence
  Computer-generated peptide variant
LLRLFKKFYKMMKNKNPLMLCLFRAKLFKLRRLVKNKLITMKSG

SEQ ID NO: 3930 - protein, 43 aa, Artificial Sequence
  Computer-generated peptide variant
RIRLIKKFLRKLRPCKGNTAACKSVVKRLPDAAELLFGLKWEA

SEQ ID NO: 3931 - protein, 41 aa, Artificial Sequence
  Computer-generated peptide variant
RFKWLPKWFKLLKHAYLLPLTKWLYAKLRTLILYRRWKYKG

SEQ ID NO: 3932 - protein, 33 aa, Artificial Sequence
  Computer-generated peptide variant
RLKFLNRYMKRYNRCYAGLLAMAAWRIRRPRDK

SEQ ID NO: 3933 - protein, 59 aa, Artificial Sequence
  Computer-generated peptide variant
LWRWMSRFFRKMRKFHRPDAATNDARHYAAASQLKAYLDKQALRKPCRYCRKKIAAAAA

SEQ ID NO: 3934 - protein, 40 aa, Artificial Sequence
  Computer-generated peptide variant
YWRWLHKYIKLLKSRIRCLIYIILAAAKHGRRKKLGANMA

SEQ ID NO: 3935 - protein, 50 aa, Artificial Sequence
  Computer-generated peptide variant
KFKIFNKLIKLMRRLAPRLFLIWRMKAGPGNNRVAALLFKKHRRQLEARF

SEQ ID NO: 3936 - protein, 62 aa, Artificial Sequence
  Computer-generated peptide variant
LFKLFSKMLRKYKKKVKAKQLFDRIARRFSLELLYFCLAYKWHLALRVAYRKKCLMDTLSHK

SEQ ID NO: 3937 - protein, 55 aa, Artificial Sequence
  Computer-generated peptide variant
KLRFFKKYLKLIRQFKQIKSANMKMCRKRAHCRLYNAADVLAAAGRAKKAAEKRK

SEQ ID NO: 3938 - protein, 50 aa, Artificial Sequence
  Computer-generated peptide variant
RWRWMKKMIRWLKRLKAARKIMLCCRCDRHSRIMLLLKAVKKSHLAHLAK

SEQ ID NO: 3939 - protein, 81 aa, Artificial Sequence
  Computer-generated peptide variant
RFKLLPKFLKRINKWTRRQACRWQACRRWRALAALKYARCRNTAGSMYAAEQLLKVLCSRFRLRRKRMKVKLDFRKLCSAT

SEQ ID NO: 3940 - protein, 71 aa, Artificial Sequence
  Computer-generated peptide variant
ILRFIKKLLKRIRREKTVFAKAKRLGRLKDICDKAKQCLTTELKKAIQARGRWRHATANWWAPLEALRFCL

SEQ ID NO: 3941 - protein, 32 aa, Artificial Sequence
  Computer-generated peptide variant
WLRFFRKYYRLWRTLRARLKWVRALQAGLVAT

SEQ ID NO: 3942 - protein, 21 aa, Artificial Sequence
  Computer-generated peptide variant
KLKMLKKLMRKLKQQLCFLLH

SEQ ID NO: 3943 - protein, 83 aa, Artificial Sequence
  Computer-generated peptide variant
KFKLLTRYLKLWKRRKARMQRLNRNMKATASQRKAAKRRAKIGFTLWAQMVWRSAKLLLSLHATVLSEELQAYMLRKTGLKNM

SEQ ID NO: 3944 - protein, 35 aa, Artificial Sequence
  Computer-generated peptide variant
LLKILRKLYRMMKPLAAKRTSWKSWLVMTLINRRA

SEQ ID NO: 3945 - protein, 20 aa, Artificial Sequence
  Computer-generated peptide variant
WFRFLKKWLRLFKTAPGKKL

SEQ ID NO: 3946 - protein, 72 aa, Artificial Sequence
  Computer-generated peptide variant
RWRFYRKLLKKLNSALNGWDLQRLAVVLLLWLRKNALRFSKPVCKSLNDKTLHRRLFNAAKAKRCYRKMKKE

SEQ ID NO: 3947 - protein, 49 aa, Artificial Sequence
  Computer-generated peptide variant
RWRIMKRMLRMMQRIDKVENLCILRRFLKHWARKAAALRPLKMSLYGAL

SEQ ID NO: 3948 - protein, 39 aa, Artificial Sequence
  Computer-generated peptide variant
KLKFLKRLIKRFKKMTRLGRDAKTLYCEKLAAVKKAAAV

SEQ ID NO: 3949 - protein, 54 aa, Artificial Sequence
  Computer-generated peptide variant
RYRIMKKWFRWFRRRAHSLAAALNKRLQIFKRRTARKSVKADNAECLLKKEQLY

SEQ ID NO: 3950 - protein, 28 aa, Artificial Sequence
  Computer-generated peptide variant
RFRLMQRILKLLCRAWRHCKAGLLNFLN

SEQ ID NO: 3951 - protein, 56 aa, Artificial Sequence
  Computer-generated peptide variant
WFRYMSRFFRIFNTRKKAKLSLRKLKRAAKAKSWLFLSRMRKVLARYWIPAEEGRL

SEQ ID NO: 3952 - protein, 67 aa, Artificial Sequence
  Computer-generated peptide variant
KWRFIQKLLRLMKCERKANLAEKWRQWQRPKLYRLKWLAKSDHKLKWKFEWKLCLACRYMRSIASAA

SEQ ID NO: 3953 - protein, 48 aa, Artificial Sequence
  Computer-generated peptide variant
KFKLLKRWYKRLRNLTLLKNAKAKKKVKTCRLARVLEVHWNAEFSSIY

SEQ ID NO: 3954 - protein, 28 aa, Artificial Sequence
  Computer-generated peptide variant
RYRIYRRLLRMLKKKLCDCDRARALLNA

SEQ ID NO: 3955 - protein, 50 aa, Artificial Sequence
  Computer-generated peptide variant
RFRFMCKFLRIFRRALGPGARRFRFDWKLAALATLIHLKACRFRWNKRKA

SEQ ID NO: 3956 - protein, 60 aa, Artificial Sequence
  Computer-generated peptide variant
RLKILRRFYKLLCSEPYKLMWETKLKYYKRALVRRAALVAMLAHFASKLKNNLMAPKGIY

SEQ ID NO: 3957 - protein, 69 aa, Artificial Sequence
  Computer-generated peptide variant
KIRLWRRYLRLLNRAHALRRLFKTTKLAVSKAASKDLKIKAIRRDEVKKCLALWPKFGERKIPALMALF

SEQ ID NO: 3958 - protein, 81 aa, Artificial Sequence
  Computer-generated peptide variant
RMKLLKKYFKKFCRWLALRAGIRLKSKAPQHSKTPSKVWDLACRDAREWLDLLKNRLRDRHRDKAHFARLRKQRLIFCTLD

SEQ ID NO: 3959 - protein, 52 aa, Artificial Sequence
  Computer-generated peptide variant
KFRMFRKLMRKLNNIQAALRYAATRSKWALARYLSASKSFRNKIKLMRKASW

SEQ ID NO: 3960 - protein, 60 aa, Artificial Sequence
  Computer-generated peptide variant
RLRMFRRYLKRLRKCHPKGTDKPLYTWIIRKASNKHPLDALIKKRAMKSQFILKRLLKLA

SEQ ID NO: 3961 - protein, 46 aa, Artificial Sequence
  Computer-generated peptide variant
KMKFLRKWFRLLKKGDRARWALKSCIYVLAARTASRKDWKLTKNAM

SEQ ID NO: 3962 - protein, 54 aa, Artificial Sequence
  Computer-generated peptide variant
MFKFIKKWIKKYNKLLYCFRLAALAILRSGFAVSVARLSKDKLRRKCLPVALLL

SEQ ID NO: 3963 - protein, 69 aa, Artificial Sequence
  Computer-generated peptide variant
LYRFLRKILKWFRSACMKLRKRKGQLHVLSKLAWHIFKKDGNLRLTTLWLRVLAVRTRKLKIACLKVWK

SEQ ID NO: 3964 - protein, 87 aa, Artificial Sequence
  Computer-generated peptide variant
LLKLLPKYLKFMTRALLRKRKSHLRVRKAALQVARRTRDRMIARAASLPLCKAKKYKMKKLWRQKKMARGQHLSLWKFKASYARKTP

SEQ ID NO: 3965 - protein, 68 aa, Artificial Sequence
  Computer-generated peptide variant
RWRMLRRYIRLLRKRANHKAAKPLEWNRGDNYKRLGAPLKRKSRMIGRLDLYYKANKYVMDLKPLKLY

SEQ ID NO: 3966 - protein, 39 aa, Artificial Sequence
  Computer-generated peptide variant
LLKYFKRIYKLMSKKREAQWRRRGLLDDSAMAPATATRA

SEQ ID NO: 3967 - protein, 29 aa, Artificial Sequence
  Computer-generated peptide variant
KLKLLCRLWRKYNQKRLFYDGMNAARWKM

SEQ ID NO: 3968 - protein, 57 aa, Artificial Sequence
  Computer-generated peptide variant
FLRLLKKLFRFFKKAGKLKWNTRRCGYKLHDLEPVKKRRFAYAGLRRMIEKAVLILS

SEQ ID NO: 3969 - protein, 75 aa, Artificial Sequence
  Computer-generated peptide variant
LYKFLRRLWRFLKSPASAVKGTRIDILKLRKRRLRRDVRRKREDQQALQMLAKHAITRCRSMALLLNKIGIGARF

SEQ ID NO: 3970 - protein, 20 aa, Artificial Sequence
  Computer-generated peptide variant
MMRMLRRMLRRLQRMKLVAC

SEQ ID NO: 3971 - protein, 23 aa, Artificial Sequence
  Computer-generated peptide variant
LLRLLRRLIRRWSQKPTRLIHQM

SEQ ID NO: 3972 - protein, 22 aa, Artificial Sequence
  Computer-generated peptide variant
KLRLLTKMLRRYKTSADLFYHR

SEQ ID NO: 3973 - protein, 67 aa, Artificial Sequence
  Computer-generated peptide variant
RMKYFCRLFKIIRRGKWDILNKFCSSRHKNAKNALINRRLRDKKARLIMRYAFKALMALRADKAWIA

SEQ ID NO: 3974 - protein, 23 aa, Artificial Sequence
  Computer-generated peptide variant
KLRFYTRYMRFLRRTLKLAKAAR

SEQ ID NO: 3975 - protein, 44 aa, Artificial Sequence
  Computer-generated peptide variant
FMRLMRKLLRMLRTKHAAHKLNDLKLEKTCRAWILARDLAPYMQ

SEQ ID NO: 3976 - protein, 24 aa, Artificial Sequence
  Computer-generated peptide variant
MMKLWKKWLRLLKHKVASLYPEAA

SEQ ID NO: 3977 - protein, 32 aa, Artificial Sequence
  Computer-generated peptide variant
LFKILSKYLRRLSSAECIIFAKAAVRARLKCD

SEQ ID NO: 3978 - protein, 53 aa, Artificial Sequence
  Computer-generated peptide variant
WMRYLKKMLRRLQRHKPSRMPRWLRHFAKNQANYKKRLQKQQAAAMAKRCRAL

SEQ ID NO: 3979 - protein, 58 aa, Artificial Sequence
  Computer-generated peptide variant
RLRFMTKWYKKLRSVAAARRAVHARAPVKGLAAICMRRKTDAGLKRRHQHAHALWAGL

SEQ ID NO: 3980 - protein, 23 aa, Artificial Sequence
  Computer-generated peptide variant
WLKFLKKYWKRLKRALSFKHFAD

SEQ ID NO: 3981 - protein, 91 aa, Artificial Sequence
  Computer-generated peptide variant
FLKLLTKWFRWWPTVPKRLNIRRPKKNLRAHRLIIKGGAQRLKRKLREKLLLEPELAANARKHKHQLLIKAAAYEKTLAKLKDDKSIFNVE

SEQ ID NO: 3982 - protein, 51 aa, Artificial Sequence
  Computer-generated peptide variant
RLKFLPKYYRKFTKAAGALVRCAHWLFICVAKLSKLRKMKRDWQRKLKCAK

SEQ ID NO: 3983 - protein, 48 aa, Artificial Sequence
  Computer-generated peptide variant
KWKLWKKFLRKLKCALERNNRLRLLKRMSLLADSDATHIRKLRRLKRW

SEQ ID NO: 3984 - protein, 27 aa, Artificial Sequence
  Computer-generated peptide variant
KWKLYPRLYRRWCRLRAAMALRAHLYK

SEQ ID NO: 3985 - protein, 61 aa, Artificial Sequence
  Computer-generated peptide variant
KLKLLKRYLRKYKRMKLVRAKALGARAALPLSNRMRAAHLCLRMKSNAMKLLTAMRTEWLI

SEQ ID NO: 3986 - protein, 95 aa, Artificial Sequence
  Computer-generated peptide variant
RMRLYTRMYKLLHRIAVHFGNMKRFLKYARRLGRAKAHMLLLVPKMLARRLLQPVKKHDRMGTKRFLTRALKKAHKVFNLIARGARDYRRTLVAA

SEQ ID NO: 3987 - protein, 70 aa, Artificial Sequence
  Computer-generated peptide variant
RYRWYRKFLKKLRCQSAMKLLRKGRACAHKPALALLMKMAHVRVKREKRRVCRLDRNNMAHGLSSKQDRL

SEQ ID NO: 3988 - protein, 54 aa, Artificial Sequence
  Computer-generated peptide variant
MMRIFRRILRKYKKLACTKLWILAMRTAHLVKTARLLHAHARDSIWRMGIRAAA

SEQ ID NO: 3989 - protein, 21 aa, Artificial Sequence
  Computer-generated peptide variant
KLKLLRRMYRRLRKLILSWDQ

SEQ ID NO: 3990 - protein, 88 aa, Artificial Sequence
  Computer-generated peptide variant
RYRLYKRLFKRFQTLYKRPALWAKHFPCLAIVCMDKAGLAKWKKWAKKLWAKLAMRPLWRRRLFAALARMKLISIQSLIRGDWKRELR

SEQ ID NO: 3991 - protein, 41 aa, Artificial Sequence
  Computer-generated peptide variant
RMRLWRKLFKFWSCLKPALTEKDAARKNMKQKLCGAARKKV

SEQ ID NO: 3992 - protein, 51 aa, Artificial Sequence
  Computer-generated peptide variant
KLKLWRKMLKMMQRKHHAVWATANRQKLPLHSALRQVLRRKAKHATCKKRY

SEQ ID NO: 3993 - protein, 34 aa, Artificial Sequence
  Computer-generated peptide variant
FLKLFSRLLKLLKRLSKTDLQQWKRLIAPTALRM

SEQ ID NO: 3994 - protein, 35 aa, Artificial Sequence
  Computer-generated peptide variant
IFKFLHRWFKKLRQTKLRRITAARTPLAKVANAAS

SEQ ID NO: 3995 - protein, 22 aa, Artificial Sequence
  Computer-generated peptide variant
LWKLWRKLFKLIKKHHARAGKE

SEQ ID NO: 3996 - protein, 29 aa, Artificial Sequence
  Computer-generated peptide variant
KIKYMQRLMRKLRRYALKWCSLDAFAVAL

SEQ ID NO: 3997 - protein, 63 aa, Artificial Sequence
  Computer-generated peptide variant
KFKILKRFLRLIKRWGTKKDKLFDPEAPRKLSLAVEFEPRARALRRYIRNTLPLKLACPMARF

SEQ ID NO: 3998 - protein, 34 aa, Artificial Sequence
  Computer-generated peptide variant
MLKFLRRLIKILSNCAHLARAFQKKAALDAHHKK

SEQ ID NO: 3999 - protein, 36 aa, Artificial Sequence
  Computer-generated peptide variant
RWRLLKRFMKKWNRIKCNRLKWKPFAHCKYSALLAA

SEQ ID NO: 4000 - protein, 32 aa, Artificial Sequence
  Computer-generated peptide variant
FLRLFSRLIRLLQHLKAPARCGKKRRGVGKWC

SEQ ID NO: 4001 - protein, 25 aa, Artificial Sequence
  Computer-generated peptide variant
LLRLFPRLFRRWRRAKALADKRLHC

SEQ ID NO: 4002 - protein, 43 aa, Artificial Sequence
  Computer-generated peptide variant
MFKFLKKWLRLMRKSLAYQQEAQLLFARPRCAKLTKKAPKDKL

SEQ ID NO: 4003 - protein, 52 aa, Artificial Sequence
  Computer-generated peptide variant
KLKMLKKLLKRFRNFKVIREYSHERAAQTRLLAKACMEKASAKFTCGHLIAK

SEQ ID NO: 4004 - protein, 41 aa, Artificial Sequence
  Computer-generated peptide variant
RYRFLKKMLKRMRKALLADREGLPDASMAFAGLMCSYALRH

SEQ ID NO: 4005 - protein, 25 aa, Artificial Sequence
  Computer-generated peptide variant
KLKLLQRFLKLLPNWKARMVRKTLS

SEQ ID NO: 4006 - protein, 36 aa, Artificial Sequence
  Computer-generated peptide variant
KYRMLHRLWRLFSKNQALAAKCVPRAAHFEKMKGLR

SEQ ID NO: 4007 - protein, 21 aa, Artificial Sequence
  Computer-generated peptide variant
LLKYWKKFYRRYRKLDYQAML

SEQ ID NO: 4008 - protein, 83 aa, Artificial Sequence
  Computer-generated peptide variant
KWRLLKRMWKRFKRNARKSRAKALKELHAAKSRKLDNYLGWFLRVKKVWLRATFKKRHMGKNPAIRNVHQHSAQRWDLKCNAA

SEQ ID NO: 4009 - protein, 24 aa, Artificial Sequence
  Computer-generated peptide variant
RLKLWRKMFKFFRKANALSAGEAC

SEQ ID NO: 4010 - protein, 22 aa, Artificial Sequence
  Computer-generated peptide variant
KLRLISRWYKRIRSPEALLRAY

SEQ ID NO: 4011 - protein, 27 aa, Artificial Sequence
  Computer-generated peptide variant
KWKLYCRLLRKIKPWSYRALLRLKPAK

SEQ ID NO: 4012 - protein, 85 aa, Artificial Sequence
  Computer-generated peptide variant
KLRMYHKLMKYLNTALKKQARLNLLTLEMKEVLRGLAKRRLALAAVFWNAHCVLTKQACGYLARNEYRDKPGRACDAKRFLLKSL

SEQ ID NO: 4013 - protein, 89 aa, Artificial Sequence
  Computer-generated peptide variant
KFKYLRKYIRFLKTAKAWRGYERKRVRARHKHENIKARLGLFTILRVILVKRAALWGAPKRIRLDLRPFLVDRLAISLALKGFLGKKTQ

SEQ ID NO: 4014 - protein, 67 aa, Artificial Sequence
  Computer-generated peptide variant
KLKLLRRFFKFIKKFRQARGLKAWKLALKLANKMREREFNGFKGLSFNRPGLMVNLHKYRLANATWR

SEQ ID NO: 4015 - protein, 46 aa, Artificial Sequence
  Computer-generated peptide variant
LFRLLRKLFRKMKKKFNKMAATWDNLLGGPLRKKAASRALKIARDD

SEQ ID NO: 4016 - protein, 37 aa, Artificial Sequence
  Computer-generated peptide variant
FLKWYKKWWRWLRHLRYKRFAALIKKLTLCLLSKKDN

SEQ ID NO: 4017 - protein, 58 aa, Artificial Sequence
  Computer-generated peptide variant
KLKYLPKLMRRFNHIRKARRLLANKLAARCNCMYRKLEKQVAKGEKTKYTGMGLIKLC

SEQ ID NO: 4018 - protein, 40 aa, Artificial Sequence
  Computer-generated peptide variant
KYKWFHRWLRKLSSRKLGRLAPSLRHLQLGARIAAAHDGP

SEQ ID NO: 4019 - protein, 37 aa, Artificial Sequence
  Computer-generated peptide variant
KYKWLRRLLRLFCKIFMMRESRKQLAKRAQGEAAVYA

SEQ ID NO: 4020 - protein, 58 aa, Artificial Sequence
  Computer-generated peptide variant
MFKLMTRYIRKLKCDKNQKLACDVKAVRLKGDAIGAFKVPLATARLRAAAFDRAWKHL

SEQ ID NO: 4021 - protein, 27 aa, Artificial Sequence
  Computer-generated peptide variant
KLKLLKRILKRLPRKLAKTANCEFQFR

SEQ ID NO: 4022 - protein, 26 aa, Artificial Sequence
  Computer-generated peptide variant
KWKFFSRLLRMIKCTLLKARANANKV

SEQ ID NO: 4023 - protein, 36 aa, Artificial Sequence
  Computer-generated peptide variant
KWKIWRRLWRFFKKRKRAYRHKAAYAALHMGPGWLL

SEQ ID NO: 4024 - protein, 39 aa, Artificial Sequence
  Computer-generated peptide variant
MWRLWKRMYRLWKRLPFRADWKARSLWPKVRLFSKALLA

SEQ ID NO: 4025 - protein, 27 aa, Artificial Sequence
  Computer-generated peptide variant
LYRLIQKYLKFLRKARCAKFGGRCKDA

SEQ ID NO: 4026 - protein, 20 aa, Artificial Sequence
  Computer-generated peptide variant
LYKMMRRLMRLLNKRQLWMY

SEQ ID NO: 4027 - protein, 44 aa, Artificial Sequence
  Computer-generated peptide variant
RLKLWSKLIKRWPRHGCGLCQRAAFLKALKAKSEARKCLFQWKN

SEQ ID NO: 4028 - protein, 43 aa, Artificial Sequence
  Computer-generated peptide variant
YYRMFKRFIRRISKKYCRELRKWLIAPLLDLPQPALLLKKRLY

SEQ ID NO: 4029 - protein, 45 aa, Artificial Sequence
  Computer-generated peptide variant
RYRMLHRMLRRMRHLLKKVDDRPRRAAQGKLYLHHWAEALYRLLR

SEQ ID NO: 4030 - protein, 41 aa, Artificial Sequence
  Computer-generated peptide variant
LIKLYRKYMKLMKPLRTFSRNTLELSYLLTNYALKRKRAWR

SEQ ID NO: 4031 - protein, 46 aa, Artificial Sequence
  Computer-generated peptide variant
RFRYFKKWLRIFCPWLRLDRLAKRAAKYKTKMAINKFLRRAFAQLI

SEQ ID NO: 4032 - protein, 67 aa, Artificial Sequence
  Computer-generated peptide variant
IMRLLKKFIKRIRCHAMHFRRYKLKLGARQLKSLQNRAALGLAAYLRLLLCGECKLSARDRDRGFIR

SEQ ID NO: 4033 - protein, 20 aa, Artificial Sequence
  Computer-generated peptide variant
ILKIIKRLWKLLKQMRCASN

SEQ ID NO: 4034 - protein, 87 aa, Artificial Sequence
  Computer-generated peptide variant
KFKLMKRMMKKWKKRAKLMAMANRANAFCAASARAIFYLLIWGIFRLLVGRRAEKFLAKCHVRKNLYRQLLLIVRVKARLLIWARGC

SEQ ID NO: 4035 - protein, 25 aa, Artificial Sequence
  Computer-generated peptide variant
RWKLLPRFWRKYRTDLLAVYQRLAK

SEQ ID NO: 4036 - protein, 85 aa, Artificial Sequence
  Computer-generated peptide variant
YWRYYCRFWRKFKKVLNKLRRATTMKWLCLNAFRSWDRWEGHRLRARGLWLALYAAKLRKRTAWKKAAACSRKCFSMKKVLFTKK

SEQ ID NO: 4037 - protein, 39 aa, Artificial Sequence
  Computer-generated peptide variant
RMRILKRIIRKFRSLLAHAAAKRRYDRARPHNLPFALLK

SEQ ID NO: 4038 - protein, 22 aa, Artificial Sequence
  Computer-generated peptide variant
KLKLFSRMLRLWCRQYLLRESR

SEQ ID NO: 4039 - protein, 51 aa, Artificial Sequence
  Computer-generated peptide variant
KLKIIRKFLRLINRAQARAGKQMDAQIRARVRLPERAMANPSRPHAKKAWL

SEQ ID NO: 4040 - protein, 33 aa, Artificial Sequence
  Computer-generated peptide variant
RLKFYRRYIKRLRKHIRLWILNKLAFLAYTLPT

SEQ ID NO: 4041 - protein, 47 aa, Artificial Sequence
  Computer-generated peptide variant
YIKILQKYIRLLKPHAKLAAKFLKWRDWAGILLLRSRSRMKFRRMKR

SEQ ID NO: 4042 - protein, 39 aa, Artificial Sequence
  Computer-generated peptide variant
KLKLLKKFFRRLTKDKKPRNWAGATNLTARLAAIKPTLQ

SEQ ID NO: 4043 - protein, 43 aa, Artificial Sequence
  Computer-generated peptide variant
RIRLMKKLLKRFQNKVCRSWHALKGASKDACRGLCHRLYAAKR

SEQ ID NO: 4044 - protein, 81 aa, Artificial Sequence
  Computer-generated peptide variant
FLRYMKKMWKKLTHKKTLDKYWASTRARNQKLLYLKDRRGTQKRLPEAKRLRLARKFDALSKLVPTENARDKLRKILKIQD

SEQ ID NO: 4045 - protein, 30 aa, Artificial Sequence
  Computer-generated peptide variant
KLKWWRKLFKKLTKCLKLEALLVRCDARKD

SEQ ID NO: 4046 - protein, 59 aa, Artificial Sequence
  Computer-generated peptide variant
FMKLYCRLWKKMTSRRRARYLAALAILLKFPKMTESSSRPKKWWMWALLCFRRKDLKKK

SEQ ID NO: 4047 - protein, 85 aa, Artificial Sequence
  Computer-generated peptide variant
KWRFLCKMIRLIRSAFKALARNKSKKCLQYAKLARNQKTDLAFRARLLYRLKPLTAAMKKHKKMDCNRERVICRCANDKFIAARR

SEQ ID NO: 4048 - protein, 40 aa, Artificial Sequence
  Computer-generated peptide variant
LYRMYPRLLRIFTRKLMKHDLAKGAPRLAKEKCLRMWGKK

SEQ ID NO: 4049 - protein, 73 aa, Artificial Sequence
  Computer-generated peptide variant
LLRIIKRWIRKIKNKSALKRVCVAAKSALMRNAAIKLLMLCDKRIIRKDRPYRYYCLHSHCLRHARSKAKLLR

SEQ ID NO: 4050 - protein, 38 aa, Artificial Sequence
  Computer-generated peptide variant
MFKMLNKFLKRFRHAWKNRLLRLLANCRYRVKWKKLLL

SEQ ID NO: 4051 - protein, 34 aa, Artificial Sequence
  Computer-generated peptide variant
RLKLFNRYLKRIPTPKEKELFLKASLYRKLLPLH

SEQ ID NO: 4052 - protein, 25 aa, Artificial Sequence
  Computer-generated peptide variant
LLRWFNRWLKKMRHNKHHILKFRAL

SEQ ID NO: 4053 - protein, 24 aa, Artificial Sequence
  Computer-generated peptide variant
LYRLLRRLFRRFNKVELMHLKKDF

SEQ ID NO: 4054 - protein, 35 aa, Artificial Sequence
  Computer-generated peptide variant
RLKIWRRLYRRIPSKKHAATKDAAATLNASSKWLK

SEQ ID NO: 4055 - protein, 32 aa, Artificial Sequence
  Computer-generated peptide variant
KMRWFTRYIRKYRTLNAGKVRKARLFAQYALL

SEQ ID NO: 4056 - protein, 38 aa, Artificial Sequence
  Computer-generated peptide variant
KWRMLRRWFRRWRRKAKRPAALKLRPLVCLPWHLWLGA

SEQ ID NO: 4057 - protein, 33 aa, Artificial Sequence
  Computer-generated peptide variant
RLRWLRKFLRKFKTLLALKQKRIKCAMDCLWSD

SEQ ID NO: 4058 - protein, 21 aa, Artificial Sequence
  Computer-generated peptide variant
LWRLMPKYMKKLRKNLNAKLH

SEQ ID NO: 4059 - protein, 24 aa, Artificial Sequence
  Computer-generated peptide variant
KMKLFHKFWKLIKKNPKLKTANAA

SEQ ID NO: 4060 - protein, 43 aa, Artificial Sequence
  Computer-generated peptide variant
WMRILKKLFRKWSNAKSKLFKLHALAKMKASATSRFAGYTALW

SEQ ID NO: 4061 - protein, 40 aa, Artificial Sequence
  Computer-generated peptide variant
RWKFMKKLFKLLRSRTDKMKIGATNRCACALPALANIKRK

SEQ ID NO: 4062 - protein, 33 aa, Artificial Sequence
  Computer-generated peptide variant
RLKLFRRFLRKLSRRNAAFSNTQRKPHLKAAKA

SEQ ID NO: 4063 - protein, 51 aa, Artificial Sequence
  Computer-generated peptide variant
IIRLLRRLYKKWSCAKALVLAQMKTRDDNKALADLDGLAKKALNGKKYRIQ

SEQ ID NO: 4064 - protein, 30 aa, Artificial Sequence
  Computer-generated peptide variant
KFRLLKKILRKWHNAKLGQLSNGTRFLLVA

SEQ ID NO: 4065 - protein, 20 aa, Artificial Sequence
  Computer-generated peptide variant
RWKWLNRIFRYLRRAAEKAQ

SEQ ID NO: 4066 - protein, 21 aa, Artificial Sequence
  Computer-generated peptide variant
RLRYFRRLLRFMKHQASYGAL

SEQ ID NO: 4067 - protein, 50 aa, Artificial Sequence
  Computer-generated peptide variant
LWKILRKYWKILSRVKSYKLEKRLNKLAFCQALGLLKRFTARRKLKKFWA

SEQ ID NO: 4068 - protein, 56 aa, Artificial Sequence
  Computer-generated peptide variant
LWKLLKRILKLIKCLWMKHEALVTRRGKMRKAAKLKYLAFAARRKLRKMAVLKPAQ

SEQ ID NO: 4069 - protein, 30 aa, Artificial Sequence
  Computer-generated peptide variant
LWKLLPRFLRRIHTYKYNYRLAAWRARRSM

SEQ ID NO: 4070 - protein, 39 aa, Artificial Sequence
  Computer-generated peptide variant
RLRWFKKLLKKFKKLSLPKGLARKKWEYLYFKLFAPLCV

SEQ ID NO: 4071 - protein, 23 aa, Artificial Sequence
  Computer-generated peptide variant
KWRLFQRILRKLKQYAEHARLFR

SEQ ID NO: 4072 - protein, 25 aa, Artificial Sequence
  Computer-generated peptide variant
RYRMWKKWLRYLRRARLPLYTLAKW

SEQ ID NO: 4073 - protein, 34 aa, Artificial Sequence
  Computer-generated peptide variant
RFRLIRKLLRLLKKWNPKELKKVPASMASRRELN

SEQ ID NO: 4074 - protein, 21 aa, Artificial Sequence
  Computer-generated peptide variant
KYKLLCKYIKRLNKLFARLKH

SEQ ID NO: 4075 - protein, 42 aa, Artificial Sequence
  Computer-generated peptide variant
FLRLLCRLFKRYNKRLRYKVIKKNAFLPCKKESARVYALKNQ

SEQ ID NO: 4076 - protein, 23 aa, Artificial Sequence
  Computer-generated peptide variant
KWKYYQRFLRLWRQAALCRQGAK

SEQ ID NO: 4077 - protein, 49 aa, Artificial Sequence
  Computer-generated peptide variant
FLKLYKKLIKLYQSVRAKVAPDLKRLHVKPEMKKAEGAKRPKLMRSAAL

SEQ ID NO: 4078 - protein, 30 aa, Artificial Sequence
  Computer-generated peptide variant
FWKLLRRWWRKFRRTKAYYCAKAAALGSRQ

SEQ ID NO: 4079 - protein, 45 aa, Artificial Sequence
  Computer-generated peptide variant
MYKFIRKIFRRLKNRKPKLILLASRRAAAKAAKAFMLIRIVKAAC

SEQ ID NO: 4080 - protein, 32 aa, Artificial Sequence
  Computer-generated peptide variant
KWRLLRRIFRWLRKCHTMRAAELDGYCRRLQA

SEQ ID NO: 4081 - protein, 42 aa, Artificial Sequence
  Computer-generated peptide variant
KLKYFCKWWKKLRQEEAAPLRIALNRLEARRMANALRRHFMK

SEQ ID NO: 4082 - protein, 83 aa, Artificial Sequence
  Computer-generated peptide variant
KMRLYNRILKFMTTTKTALAWDDKWAKKKACKIEWAKKARAPRAYFKKACKGTERPKALLSKKCLPVKLLPAKLEKDYRMKAQ

SEQ ID NO: 4083 - protein, 49 aa, Artificial Sequence
  Computer-generated peptide variant
RFKLLCRFWKRLHNRFAWMNCDLKRRKNLWLKVWATLHMARMADRLQLR

SEQ ID NO: 4084 - protein, 34 aa, Artificial Sequence
  Computer-generated peptide variant
KFRLLCKLWKKMKHVWKLLATAEDKRQPAAQNLA

SEQ ID NO: 4085 - protein, 27 aa, Artificial Sequence
  Computer-generated peptide variant
LMRLLRKFMRKFKQRLQRALASTEEAP

SEQ ID NO: 4086 - protein, 22 aa, Artificial Sequence
  Computer-generated peptide variant
RLKLFSKMLKKLHQAHLERAAF

SEQ ID NO: 4087 - protein, 21 aa, Artificial Sequence
  Computer-generated peptide variant
FLRLWKRLIKRFKTHAKTARA

SEQ ID NO: 4088 - protein, 57 aa, Artificial Sequence
  Computer-generated peptide variant
KFKYLSKMWRRMQQACRMFLLNYAWCNCTKSPLARRTANSFVKRLRLARKLKKRLLA

SEQ ID NO: 4089 - protein, 82 aa, Artificial Sequence
  Computer-generated peptide variant
LFKLLKRILKKFNRFILIDYPLKYSRMSALELAALESKKRKGNNLDIRLKTVLVPAAYRYKKKRSSRLRLGARLLASDRAWA

SEQ ID NO: 4090 - protein, 20 aa, Artificial Sequence
  Computer-generated peptide variant
KIRLLHRWLKRFHSPAARRF

SEQ ID NO: 4091 - protein, 42 aa, Artificial Sequence
  Computer-generated peptide variant
RMKLLKKLMRILRKYAERRFLAGCALKMLLFELLKRDARAEL

SEQ ID NO: 4092 - protein, 25 aa, Artificial Sequence
  Computer-generated peptide variant
LMRMFKKILKRLKQLMKLVQSHPLA

SEQ ID NO: 4093 - protein, 33 aa, Artificial Sequence
  Computer-generated peptide variant
KIKLFKRWLRRLRSCHNKSLKRNEALMLRKANA

SEQ ID NO: 4094 - protein, 24 aa, Artificial Sequence
  Computer-generated peptide variant
RIKLLQRILKRLRKFKALILVNCV

SEQ ID NO: 4095 - protein, 58 aa, Artificial Sequence
  Computer-generated peptide variant
RIKLFRRLIKKFQRLLWKRKPMMNGPLVAADKALYGAPRERKKLNLGEWSKLNSRLKA

SEQ ID NO: 4096 - protein, 41 aa, Artificial Sequence
  Computer-generated peptide variant
RWRLLNKFIRLWKNALHCAAKKLVAKAARAMLDRRTTLGCA

SEQ ID NO: 4097 - protein, 23 aa, Artificial Sequence
  Computer-generated peptide variant
LFRYWRKWYKLMKHQGRHARAAA

SEQ ID NO: 4098 - protein, 30 aa, Artificial Sequence
  Computer-generated peptide variant
RLKLFKKLYKFIHRRANLCLGGIEDAKKVK

SEQ ID NO: 4099 - protein, 56 aa, Artificial Sequence
  Computer-generated peptide variant
LMRYFKKLLRRFKKQIKMALLRVKRLKLLALKGRVFTLKLAFKLTTRWRLERWLVL

SEQ ID NO: 4100 - protein, 73 aa, Artificial Sequence
  Computer-generated peptide variant
RFKYFRKMFRLFKRAKTCDALYKLERFLQTDKKRLIRREDAYNKMRLFNAIRLTLMQSARLARRNLAEARMNK

SEQ ID NO: 4101 - protein, 40 aa, Artificial Sequence
  Computer-generated peptide variant
RYRMFQRLLKRMKPDALQWRRFIAVCLKLASANKKKHLAQ

SEQ ID NO: 4102 - protein, 97 aa, Artificial Sequence
  Computer-generated peptide variant
LMKFFCKFMRLLPCFALYVALSAKTKECVLMNMMILKTFLRKALLADIAPEGRGAWKRLKRKQPLLEDLGHLKHLKAARRRARSVKLMLCRKAVHAR

SEQ ID NO: 4103 - protein, 24 aa, Artificial Sequence
  Computer-generated peptide variant
FLRFMRRLMRLMRRKTALAAKLSH

SEQ ID NO: 4104 - protein, 21 aa, Artificial Sequence
  Computer-generated peptide variant
LYKILTRFYKMLTRDKRALPL

SEQ ID NO: 4105 - protein, 40 aa, Artificial Sequence
  Computer-generated peptide variant
KLRFWRRFLKKFRNKGFVAQLGKFLMARWKEAKHVMAKPA

SEQ ID NO: 4106 - protein, 47 aa, Artificial Sequence
  Computer-generated peptide variant
KWRFMRKFLKRFNSAMSKAAQNARHMAAYRNAVSLLKHKLRLLNFIK

SEQ ID NO: 4107 - protein, 24 aa, Artificial Sequence
  Computer-generated peptide variant
WLRFWRKLFKRMRRSKPYALACFA

SEQ ID NO: 4108 - protein, 29 aa, Artificial Sequence
  Computer-generated peptide variant
FLRYYKRMLRRLRNSWDQKKKAHAAFDAC

SEQ ID NO: 4109 - protein, 22 aa, Artificial Sequence
  Computer-generated peptide variant
KMKWYCKLLRLISKWAYANKKA

SEQ ID NO: 4110 - protein, 33 aa, Artificial Sequence
  Computer-generated peptide variant
RWRLLRRFMRFLKKAVAFAKIPRKCNCAKYEMA

SEQ ID NO: 4111 - protein, 41 aa, Artificial Sequence
  Computer-generated peptide variant
LWRILKKMLRKYNQRGLRCFLSVRAVDKARRLCLSMEALAA

SEQ ID NO: 4112 - protein, 38 aa, Artificial Sequence
  Computer-generated peptide variant
LLKFLRRLLKRWRRHKKLAALKAKDRDVLPDCLARKLM

SEQ ID NO: 4113 - protein, 26 aa, Artificial Sequence
  Computer-generated peptide variant
KLRLLRRLLRRFKHEASRLNLTKRAI

SEQ ID NO: 4114 - protein, 37 aa, Artificial Sequence
  Computer-generated peptide variant
ILRFMKKLLKRLQRTYKTTAFTHSHHNLKKILKLKKL

SEQ ID NO: 4115 - protein, 33 aa, Artificial Sequence
  Computer-generated peptide variant
KLRWFSRLWRLFNNLGHKLTKLVKLTWLLAKWR

SEQ ID NO: 4116 - protein, 32 aa, Artificial Sequence
  Computer-generated peptide variant
YFKFICRLFRRLHKQRLAKRRYLKRAKGLAWL

SEQ ID NO: 4117 - protein, 36 aa, Artificial Sequence
  Computer-generated peptide variant
RFRLLNRLLRLMNKKRARWQSLNLKVSKWGHTFAAM

SEQ ID NO: 4118 - protein, 46 aa, Artificial Sequence
  Computer-generated peptide variant
FIRFWKKLMKKLKRMRLLLLLGRFAAFQDDAGSHKCILRRMAKHVA

SEQ ID NO: 4119 - protein, 44 aa, Artificial Sequence
  Computer-generated peptide variant
RYKWLCRLFRLIHPPNAAWKDLERLELHFHARSRRKVAAKRRWR

SEQ ID NO: 4120 - protein, 64 aa, Artificial Sequence
  Computer-generated peptide variant
KMRFWKKLWRLLRRMEKRRRDLGYRWRLRNANQIQLPYALRSKRRLNLLATAMAKLRLAWNKIT

SEQ ID NO: 4121 - protein, 38 aa, Artificial Sequence
  Computer-generated peptide variant
KLKFFRRLLRWMRKYMAFGTRWLPNTTLRPAKGLRAQR

SEQ ID NO: 4122 - protein, 22 aa, Artificial Sequence
  Computer-generated peptide variant
LMRLIPRLYRKIPSACAHKRLR

SEQ ID NO: 4123 - protein, 25 aa, Artificial Sequence
  Computer-generated peptide variant
MLKMLRRFLRRLKKTRASANLPIVF

SEQ ID NO: 4124 - protein, 39 aa, Artificial Sequence
  Computer-generated peptide variant
KMRLLRRWLKYYRTLRFACRRRLDHGLMQGFNLLKYLAH

SEQ ID NO: 4125 - protein, 52 aa, Artificial Sequence
  Computer-generated peptide variant
RYRLYNRYYRLYKHLRRTRAKQDCLQSHDGRAKRLKLQAWDLWLLRRLFAQE

SEQ ID NO: 4126 - protein, 27 aa, Artificial Sequence
  Computer-generated peptide variant
LMRYLPKLWRKLNQLRKLQLEPLDLKR

SEQ ID NO: 4127 - protein, 42 aa, Artificial Sequence
  Computer-generated peptide variant
KLRMYHRLYRLIKKLGMTKRPKLIKRTALLIMNNRQDLKRAM

SEQ ID NO: 4128 - protein, 78 aa, Artificial Sequence
  Computer-generated peptide variant
RLRLLRKLIKYIRHIVATCATRKSRCLHMICALLVKTIAMARHPTLKAAQSKLWAEKLLARPKRALRPLVMIVYIPAL

SEQ ID NO: 4129 - protein, 23 aa, Artificial Sequence
  Computer-generated peptide variant
KMRIYRRLIRRMQPRLAAWQHLA

SEQ ID NO: 4130 - protein, 92 aa, Artificial Sequence
  Computer-generated peptide variant
RFKYWHRLLRYFPKLLWLLPRRAQLWLRRATWIWRSLHALKRSKHQHKVKAKWAMRAAPRRRADVWIYAYLFNEPLQKVTAQDKKKAALFKA

SEQ ID NO: 4131 - protein, 40 aa, Artificial Sequence
  Computer-generated peptide variant
KLRYMTRWLKLLSKSKAKIKYRAASTLGRRMKHWLGALDN

SEQ ID NO: 4132 - protein, 41 aa, Artificial Sequence
  Computer-generated peptide variant
ILKFLCRWFKKLSKLAPLRKRQGHQASLKLALSAWLLKITH

SEQ ID NO: 4133 - protein, 41 aa, Artificial Sequence
  Computer-generated peptide variant
LLRWLRRFLKKYKNCPTQVAIPRKRASAKEYDLLRTRIIKL

SEQ ID NO: 4134 - protein, 63 aa, Artificial Sequence
  Computer-generated peptide variant
LLRLFTRILKFMRQVAWQARGHFRRKALAATWLEKKVARRMTACLAKLTRRALRYVVEEHKVV

SEQ ID NO: 4135 - protein, 60 aa, Artificial Sequence
  Computer-generated peptide variant
RLRIFTRMLKRLTPKKAKRAQRIWPRSACLAMPRLGLLRKWRVAAHAEVCTDLAFLRRDA

SEQ ID NO: 4136 - protein, 44 aa, Artificial Sequence
  Computer-generated peptide variant
LFKMFKRYLRKFRRARYLLLLGATARLKWLRLAIERALNRYKAA

SEQ ID NO: 4137 - protein, 97 aa, Artificial Sequence
  Computer-generated peptide variant
RYKFLNKLLRKIRKEVVTIARFKFLLASRRMYKAATRLERRHETQPKMGALDLCGKADALKYAAKLRLWGSNQLKFYDADVQALLLLWVREVKKRRR

SEQ ID NO: 4138 - protein, 20 aa, Artificial Sequence
  Computer-generated peptide variant
KLRFMRRMWRLLHRKNVHLA

SEQ ID NO: 4139 - protein, 29 aa, Artificial Sequence
  Computer-generated peptide variant
LWRWFHKLLRMLSPKCGHNALRLKQNKLR

SEQ ID NO: 4140 - protein, 29 aa, Artificial Sequence
  Computer-generated peptide variant
MWKILKKIYRKLKRAVLCLHLKAKTSRLA

SEQ ID NO: 4141 - protein, 62 aa, Artificial Sequence
  Computer-generated peptide variant
KWKMLRKMIKLIPRRDNLFKKQDMALCKHKKKLSLLRYRHLTAAALDKATLPLHLWRVAWYL

SEQ ID NO: 4142 - protein, 21 aa, Artificial Sequence
  Computer-generated peptide variant
IWRLFKKFIKLLPKWAARHAD

SEQ ID NO: 4143 - protein, 63 aa, Artificial Sequence
  Computer-generated peptide variant
FFRFLKKLFKRLRRLLGQLSTLAADMDREKARVKIKILRRRAWAAWRGLATLLRVDAHKGLEH

SEQ ID NO: 4144 - protein, 38 aa, Artificial Sequence
  Computer-generated peptide variant
KWRLLRRIMRKYKKLRQLRLRLALETDRFMAKHKAGLH

SEQ ID NO: 4145 - protein, 32 aa, Artificial Sequence
  Computer-generated peptide variant
KLKLLRRFWKKYKSAKWAVVTFRRPAIANCLI

SEQ ID NO: 4146 - protein, 88 aa, Artificial Sequence
  Computer-generated peptide variant
RFRLLTRLLKRIRPRKCIRALALMRIKRAASAKFHLLSPIHAPYIKKWAAYKAKDAFLKASKAKLATRCKFMWAQNHKPNKADRMRFL

SEQ ID NO: 4147 - protein, 20 aa, Artificial Sequence
  Computer-generated peptide variant
RWRYLSKFLRRYTKELPALV

SEQ ID NO: 4148 - protein, 58 aa, Artificial Sequence
  Computer-generated peptide variant
KFRWLRKLLRRWKKELKFFRAFLRQYKTRMNERPALFACRDSAAKQKTGNARSLEAYC

SEQ ID NO: 4149 - protein, 36 aa, Artificial Sequence
  Computer-generated peptide variant
KLKFYRKWIRWLRRLANALRLDGLNRASGTLKKSWS

SEQ ID NO: 4150 - protein, 40 aa, Artificial Sequence
  Computer-generated peptide variant
WFRYLRRFLRFLRHLPMRLSARQRWHAHRGLVARACCRDL

SEQ ID NO: 4151 - protein, 28 aa, Artificial Sequence
  Computer-generated peptide variant
LLRYFPKMFRRLRRRTLAAGLLTYHAHK

SEQ ID NO: 4152 - protein, 20 aa, Artificial Sequence
  Computer-generated peptide variant
RLRFLKRFFKRLSNLEECLR

SEQ ID NO: 4153 - protein, 48 aa, Artificial Sequence
  Computer-generated peptide variant
RYRFMKKMLRFICKLKLLAAEALLRRATLIHRMPHAKLSMLCDRLPCG

SEQ ID NO: 4154 - protein, 35 aa, Artificial Sequence
  Computer-generated peptide variant
MFRILKKWLRRWNKKIEARLCYRKYAWLLPRAAAN

SEQ ID NO: 4155 - protein, 55 aa, Artificial Sequence
  Computer-generated peptide variant
RLRFLKRYLKRLCRVERQKCRKRAKLEWALASGAQGALNLYRRRACCDPPTDSKM

SEQ ID NO: 4156 - protein, 56 aa, Artificial Sequence
  Computer-generated peptide variant
KLRWIQKWLRFWKSRKQPLALQNAMLYIPCARARAKGALACRRNVAHLTRLRLTNR

SEQ ID NO: 4157 - protein, 27 aa, Artificial Sequence
  Computer-generated peptide variant
RLRMFCKYLRKWSTRARLKLDACAVTA

SEQ ID NO: 4158 - protein, 22 aa, Artificial Sequence
  Computer-generated peptide variant
YYRLITKLLKRLTHLGDARRQL

SEQ ID NO: 4159 - protein, 23 aa, Artificial Sequence
  Computer-generated peptide variant
RLRWFTRYLKRLKKANRLYASAI

SEQ ID NO: 4160 - protein, 69 aa, Artificial Sequence
  Computer-generated peptide variant
KFKYFKRLFKKLPHAAKRLNRIKLVQRFLCALYHALANEQAKARDKKQKSGCWDDWAAKKRGMSKYKLA

SEQ ID NO: 4161 - protein, 39 aa, Artificial Sequence
  Computer-generated peptide variant
RIKWLCRYLKLWRHVKFQAAYLDRLKRSLYKKNTLRAYH

SEQ ID NO: 4162 - protein, 24 aa, Artificial Sequence
  Computer-generated peptide variant
KLRLWQRFLKKLTRKGWLDCAELL

SEQ ID NO: 4163 - protein, 37 aa, Artificial Sequence
  Computer-generated peptide variant
KLRLIPKLLKKINRGFWKLIARLEKKAAEYRSQFCMA

SEQ ID NO: 4164 - protein, 35 aa, Artificial Sequence
  Computer-generated peptide variant
FYKLIQKLIKFLKKRKLAVLNRRRCAKCLAGGLKL

SEQ ID NO: 4165 - protein, 20 aa, Artificial Sequence
  Computer-generated peptide variant
KIKIYQKMLRRLQKLRNLLN

SEQ ID NO: 4166 - protein, 65 aa, Artificial Sequence
  Computer-generated peptide variant
YFKFFHRWMRFLQRRFAERARKAIQACTLEYQLRRQAAYRRPKALHGLVFLTALRPIKKAARALA

SEQ ID NO: 4167 - protein, 25 aa, Artificial Sequence
  Computer-generated peptide variant
KLRLFSKFLKFFRKCNRLYLARRSA

SEQ ID NO: 4168 - protein, 39 aa, Artificial Sequence
  Computer-generated peptide variant
KWRWLRKWLKRLRRSQYNKKAKYAALLKPVPLTGKAIAL

SEQ ID NO: 4169 - protein, 27 aa, Artificial Sequence
  Computer-generated peptide variant
LFKFFNKLLKFFRKLKNASNEQALKLA

SEQ ID NO: 4170 - protein, 39 aa, Artificial Sequence
  Computer-generated peptide variant
RLKLLPRYLKRLRNKYFKQAIKIMANRSKWNHMLCALLN

SEQ ID NO: 4171 - protein, 29 aa, Artificial Sequence
  Computer-generated peptide variant
IFKLLKKLMRFMKHARLATRRPHMDRAHS

SEQ ID NO: 4172 - protein, 23 aa, Artificial Sequence
  Computer-generated peptide variant
RLRLWRRLLKRLKSKWLARNLTL

SEQ ID NO: 4173 - protein, 30 aa, Artificial Sequence
  Computer-generated peptide variant
LWRLIRKMLRRMKPAFKAALTAGLWKQRVC

SEQ ID NO: 4174 - protein, 34 aa, Artificial Sequence
  Computer-generated peptide variant
FLRILKKFFKRLRKLSHTACKRRGVKAAAEARNP

SEQ ID NO: 4175 - protein, 28 aa, Artificial Sequence
  Computer-generated peptide variant
RLKLFRRIFRRFKTALAAKAKESDVRAC

SEQ ID NO: 4176 - protein, 48 aa, Artificial Sequence
  Computer-generated peptide variant
FMRMLQRLFKRYKRLERLMAKHCEKGPLLLIKLILCMKWLEADWALLR

SEQ ID NO: 4177 - protein, 28 aa, Artificial Sequence
  Computer-generated peptide variant
MFKWLSRLWKKLKKITAPAKDRAAFKLS

SEQ ID NO: 4178 - protein, 21 aa, Artificial Sequence
  Computer-generated peptide variant
LIKFFSKWLKMLRRRSRYNLA

SEQ ID NO: 4179 - protein, 64 aa, Artificial Sequence
  Computer-generated peptide variant
FLRLIRKMMKLYRRFNRRDANMSHPKALNRLKVPGLKLKFISKELCRRLPKALRMDCLAKLCGL

SEQ ID NO: 4180 - protein, 25 aa, Artificial Sequence
  Computer-generated peptide variant
RFKLLCRLMKKFKSHLTRLNYTGAA

SEQ ID NO: 4181 - protein, 77 aa, Artificial Sequence
  Computer-generated peptide variant
KWKLYRRYFRIIQKKGKPRRRAFALSRSRAIKRNMKFKQALYARKRFVLRLAICLKARDRTAWGQKANQDLDAEGHL

SEQ ID NO: 4182 - protein, 54 aa, Artificial Sequence
  Computer-generated peptide variant
RFKFLNRYMKWYKKYAMYKHLAKARLAGCCLAPQLKNKKANLMFRRNLPLALKF

SEQ ID NO: 4183 - protein, 96 aa, Artificial Sequence
  Computer-generated peptide variant
KLKLLRRMLRKMKKRLYLRCYDFRLAIKWVISWCLRCGYEKAYLFPVVGLRRRKGLMLPKPALIALKLDAGVLWFLRRARLLNRPVCACHERKGRR

SEQ ID NO: 4184 - protein, 80 aa, Artificial Sequence
  Computer-generated peptide variant
RWKILRRWYKRLKRPALYREKAPVFFKAEYKHELFKRKWERKKAMRANASACLKRYGCARLMAPVLNQNARATILILSAL

SEQ ID NO: 4185 - protein, 23 aa, Artificial Sequence
  Computer-generated peptide variant
KFRFMHKLYKLLRNRDKAAARAH

SEQ ID NO: 4186 - protein, 49 aa, Artificial Sequence
  Computer-generated peptide variant
KFRLLNRLLKFFQRLKRRQKMLTLSKGEDMWKLDLRFLNAKAVKADARY

SEQ ID NO: 4187 - protein, 25 aa, Artificial Sequence
  Computer-generated peptide variant
FLKWLQKLLRIMKKIADAAQRLRRN

SEQ ID NO: 4188 - protein, 38 aa, Artificial Sequence
  Computer-generated peptide variant
KFKFFSRLYRWMKHLPPLRHRLAKRARLFEKAVDKQAD

SEQ ID NO: 4189 - protein, 22 aa, Artificial Sequence
  Computer-generated peptide variant
KWRMLQKLLRLLQRKNFKYAHA

SEQ ID NO: 4190 - protein, 43 aa, Artificial Sequence
  Computer-generated peptide variant
KLKLFRKWYKKMKRKMLPAALAASAAGINLKALLILREPCSVT

SEQ ID NO: 4191 - protein, 51 aa, Artificial Sequence
  Computer-generated peptide variant
KWKFFRRLFRKFNKKAACRFQAKEYLPAIKGTRAKKLAFLLARYYKNKPGI

SEQ ID NO: 4192 - protein, 93 aa, Artificial Sequence
  Computer-generated peptide variant
KLKFMKKMWKFIKKKVYRMWKARLARRKRRLNRMAPLAKNGAALSLLDTVVCHERHFAMLTFWFLLLHRKRKRAACKHLKAEFPHSLGKLKAW

SEQ ID NO: 4193 - protein, 30 aa, Artificial Sequence
  Computer-generated peptide variant
RFKWMPRLWRFYKKPAAKLHGARTKAHAGR

SEQ ID NO: 4194 - protein, 59 aa, Artificial Sequence
  Computer-generated peptide variant
KLKFYPRFIKRLKNLKKLVFSTARVLDTWRRELMARYMLLLWRRRRLLMDRAWALHMAR

SEQ ID NO: 4195 - protein, 34 aa, Artificial Sequence
  Computer-generated peptide variant
KWRYLRRLFRIMRKHLCSAFCKMLAKLWVRVAAP

SEQ ID NO: 4196 - protein, 31 aa, Artificial Sequence
  Computer-generated peptide variant
KLKFMNRWIKKFPTLPARALHASKAMALADR

SEQ ID NO: 4197 - protein, 35 aa, Artificial Sequence
  Computer-generated peptide variant
LMRMLRRLLKLFKRKQLWATKANYGWLTEKRKKIL

SEQ ID NO: 4198 - protein, 25 aa, Artificial Sequence
  Computer-generated peptide variant
KLKFFRRWFRILKQQLLPLPAEAEK

SEQ ID NO: 4199 - protein, 30 aa, Artificial Sequence
  Computer-generated peptide variant
RLRLLPKMIRRLCHAIIRRYHRIKAKYLVI

SEQ ID NO: 4200 - protein, 74 aa, Artificial Sequence
  Computer-generated peptide variant
KLKFLPRIYRRLTNKILLKYKKNFWMWSAKTAAAGQRCAGAAPRRWLKYRKIMGLNWWRMAPKILAKLRAMVRL

SEQ ID NO: 4201 - protein, 23 aa, Artificial Sequence
  Computer-generated peptide variant
LLKFIKKILKLIKKKAVYAHAFK

SEQ ID NO: 4202 - protein, 28 aa, Artificial Sequence
  Computer-generated peptide variant
LFKFISKFFRMLRCAWKDAWRARMLAKR

SEQ ID NO: 4203 - protein, 21 aa, Artificial Sequence
  Computer-generated peptide variant
KFRLLNRLLKLYSRLSVYAVD

SEQ ID NO: 4204 - protein, 81 aa, Artificial Sequence
  Computer-generated peptide variant
LLKFFRRFLKFLHKLRDLKAHRARLIVSINPFGRLLYLKGASADSAASLQRLLAKKGNVKDDQDRLRRKAMRKKTIAFGHI

SEQ ID NO: 4205 - protein, 35 aa, Artificial Sequence
  Computer-generated peptide variant
RLRWLRRWIKKWKSHLLDDRKLHKSLEANLARSRY

SEQ ID NO: 4206 - protein, 22 aa, Artificial Sequence
  Computer-generated peptide variant
KYKLFTKLLKRFPKAIELAWGA

SEQ ID NO: 4207 - protein, 96 aa, Artificial Sequence
  Computer-generated peptide variant
KMKMLKKWYKFINPRKAKKLPSKAAAAHYRSRADKRWDVWMTAARKKDMLKDDYTHPFAVLRTAWRLNKPKAKARRTQALRPNKLWLNLKALAACR

SEQ ID NO: 4208 - protein, 36 aa, Artificial Sequence
  Computer-generated peptide variant
LFKMFKRMLRKLKRCAVQFDYAKKAWLSKRPDALTC

SEQ ID NO: 4209 - protein, 78 aa, Artificial Sequence
  Computer-generated peptide variant
KFRMFRRMYKKICPLANAVLFLKANHCLKRKAMLTSRKDLRRPLTAKGLRKKIKKQAGLRKYAKLTAKIMVLKKGDLG

SEQ ID NO: 4210 - protein, 40 aa, Artificial Sequence
  Computer-generated peptide variant
MLRYLRKLFRRLRCNNLATMFLWPHMKKRYKRVAEFYKLA

SEQ ID NO: 4211 - protein, 42 aa, Artificial Sequence
  Computer-generated peptide variant
RFRLITKFFKRLSTLPDAMALESSLLLATRKKRKRRLQNIMA

SEQ ID NO: 4212 - protein, 34 aa, Artificial Sequence
  Computer-generated peptide variant
KLKMLKKWMRKWKQLAPYEVRKLLAKAQLVRKCH

SEQ ID NO: 4213 - protein, 32 aa, Artificial Sequence
  Computer-generated peptide variant
FLKLLRKLLRKLKRAKLKLTSMPWTARTGLGL

SEQ ID NO: 4214 - protein, 52 aa, Artificial Sequence
  Computer-generated peptide variant
RYKILRRIYKRLKKWRRLVPRLDLLKCVHKIPKAQWLLGADQKAAIAYELAK

SEQ ID NO: 4215 - protein, 48 aa, Artificial Sequence
  Computer-generated peptide variant
IWRIMKKLYKKLNRARRAYLAQACAALLIKEAKRKKDERRLADLIFRH

SEQ ID NO: 4216 - protein, 26 aa, Artificial Sequence
  Computer-generated peptide variant
KFKFWRRYLRYLKPWKALRNLQELAR

SEQ ID NO: 4217 - protein, 43 aa, Artificial Sequence
  Computer-generated peptide variant
KMKLIRKLYRRLRKLAAAGKVIVDKAHRLIAQLKYRRALALTD

SEQ ID NO: 4218 - protein, 52 aa, Artificial Sequence
  Computer-generated peptide variant
RIRMLKKWFRRYRRAATAHIDHSLLFCRRMVGQKALIKCAKLHLQARAVLLA

SEQ ID NO: 4219 - protein, 43 aa, Artificial Sequence
  Computer-generated peptide variant
RWRLFKKIMKKLNKGASPWQLSYAQKRFERVYAAKKAAWKRLC

SEQ ID NO: 4220 - protein, 63 aa, Artificial Sequence
  Computer-generated peptide variant
RLKFLSKLWRRLKKRIGFTEAKKDDMGAFWKKVVLLNLKLRRIQPALALALAALNATEWEKAR

SEQ ID NO: 4221 - protein, 37 aa, Artificial Sequence
  Computer-generated peptide variant
LFKLFKRFLKFLKQKFMRPALENAQRRLKAGKALKIH

SEQ ID NO: 4222 - protein, 21 aa, Artificial Sequence
  Computer-generated peptide variant
IIRMICKLYKLLHKRQFKRAL

SEQ ID NO: 4223 - protein, 60 aa, Artificial Sequence
  Computer-generated peptide variant
FLKFWCRMLKKFRRKMRNLLKLMALKAKKMLAGERTVSRARHSMLKNLDLKKTREVNYKC

SEQ ID NO: 4224 - protein, 21 aa, Artificial Sequence
  Computer-generated peptide variant
LWKMLRRYLRWLPKLAEDCKR

SEQ ID NO: 4225 - protein, 65 aa, Artificial Sequence
  Computer-generated peptide variant
KWKWFRKWLRKFCNAPDKADYVEVLKLLLWPRNLLKTSMGRKKALKLAYALLCAMRRFPGKRKPK

SEQ ID NO: 4226 - protein, 52 aa, Artificial Sequence
  Computer-generated peptide variant
KLKLIRRLLKFFRKKKFLGDEASACKRKGTCAIKLRLNLAAMEWRKNEGLDK

SEQ ID NO: 4227 - protein, 23 aa, Artificial Sequence
  Computer-generated peptide variant
LLKFIKKYYKMFSNALALGDKKR

SEQ ID NO: 4228 - protein, 98 aa, Artificial Sequence
  Computer-generated peptide variant
KIRLFRRWFKMLRRRLHLAELKLAHAHFQVNLAFTPLLARAALLFVRHKYFGLNRYALIRYLHEKALAGAKSRYFIRKNAKELARFQKWLMAARQKNA

SEQ ID NO: 4229 - protein, 21 aa, Artificial Sequence
  Computer-generated peptide variant
RYKWFRKMLKLWSRKGAAALA

SEQ ID NO: 4230 - protein, 38 aa, Artificial Sequence
  Computer-generated peptide variant
KLKLLKKLLKKWRKPHKLQMIALLEEWHKALAHAILGK

SEQ ID NO: 4231 - protein, 24 aa, Artificial Sequence
  Computer-generated peptide variant
KMKLIKRFFRLFNKCKAKLQAAQI

SEQ ID NO: 4232 - protein, 28 aa, Artificial Sequence
  Computer-generated peptide variant
MWKLFNKYFRRLKHQILLFLFGKRAALL

SEQ ID NO: 4233 - protein, 41 aa, Artificial Sequence
  Computer-generated peptide variant
LLKLMSKYMRRWRQAKFVKLLRTVPRKGKKNYNRAAWIRAL

SEQ ID NO: 4234 - protein, 23 aa, Artificial Sequence
  Computer-generated peptide variant
KFKMLRKLLRKYRKAYMTSAMAA

SEQ ID NO: 4235 - protein, 53 aa, Artificial Sequence
  Computer-generated peptide variant
ILKFFKRIFRLLKTVAWAHLVRVSRLLFRLKLDHKARMAVKGKRRAKLWHALK

SEQ ID NO: 4236 - protein, 56 aa, Artificial Sequence
  Computer-generated peptide variant
MYRFIRRLWRWWRRPRMAFAAYIRQALGRKPANRYLCIVGALKARQARKFMAKRQK

SEQ ID NO: 4237 - protein, 67 aa, Artificial Sequence
  Computer-generated peptide variant
KLKFFRKLYKKLKTWRKLLDKLQLMRIKLMTAALKIRKLQNVKGAEGDKGRIYCYFELRLSVALKRL

SEQ ID NO: 4238 - protein, 23 aa, Artificial Sequence
  Computer-generated peptide variant
LLRWLRKWFRRFKHQGERELLLT

SEQ ID NO: 4239 - protein, 61 aa, Artificial Sequence
  Computer-generated peptide variant
RLKLWQRLLKKIKKKWCQDVKKGRFTNLRLKLWRIRYPKARVPSAYRLCALEKHGLLAGNF

SEQ ID NO: 4240 - protein, 41 aa, Artificial Sequence
  Computer-generated peptide variant
RLRYISKLFKYLRRFKLSSAYALQLKYPKLMWWALKNLGKW

SEQ ID NO: 4241 - protein, 32 aa, Artificial Sequence
  Computer-generated peptide variant
RLKIISRYLKRFRTLLKRLNLAWLKRHHRHAA

SEQ ID NO: 4242 - protein, 47 aa, Artificial Sequence
  Computer-generated peptide variant
RLKLFRKFWKRLPKRHKFLYMAHAKNVCALQAELALAIPRLLSPCKY

SEQ ID NO: 4243 - protein, 32 aa, Artificial Sequence
  Computer-generated peptide variant
KLRLMKRWFKLLCKSSASCAHTHFALVRRAAI

SEQ ID NO: 4244 - protein, 80 aa, Artificial Sequence
  Computer-generated peptide variant
RFRFIKRFMKRIPKMLEGIAMFRAAAARLAAAEDAALKEAAQCRSARVPKKCCRSSKKKLAQVCLAVAKRNDTTLSSARR

SEQ ID NO: 4245 - protein, 61 aa, Artificial Sequence
  Computer-generated peptide variant
RLKLWRRMFRKFKKYEFRQLKAANLAKPGMLFLGRVARKACARHRAFMRICFPLAAAMDHK

SEQ ID NO: 4246 - protein, 64 aa, Artificial Sequence
  Computer-generated peptide variant
RIRYFTKLFKKMRHLCRIKGLRKGLDKKLLIAKLKKCHLLALQEDQRTTAESTSLLIYLLNAAA

SEQ ID NO: 4247 - protein, 31 aa, Artificial Sequence
  Computer-generated peptide variant
LLRFMQRMMRYIHRVYRAQYKRRLRKLAAAG

SEQ ID NO: 4248 - protein, 22 aa, Artificial Sequence
  Computer-generated peptide variant
RLRLFTRYYRWFKTATLLARLL

SEQ ID NO: 4249 - protein, 29 aa, Artificial Sequence
  Computer-generated peptide variant
FLKMYHRYLKRLCRKARYSKGKQNLAEAL

SEQ ID NO: 4250 - protein, 40 aa, Artificial Sequence
  Computer-generated peptide variant
LLRFIKKWMRRMKCTWARCPSYSAIRNAGAACLLKLELAR

SEQ ID NO: 4251 - protein, 61 aa, Artificial Sequence
  Computer-generated peptide variant
WLKLWRKMLRWLKKKLLARRDKLKAHKMGKLMGLLLAKNIIGAQTAVKAARHKNVFAGKMS

SEQ ID NO: 4252 - protein, 30 aa, Artificial Sequence
  Computer-generated peptide variant
KFRLMKRLIRFIPNLYLGARYLLNLLRKNF

SEQ ID NO: 4253 - protein, 67 aa, Artificial Sequence
  Computer-generated peptide variant
RIKIMKKYLRRMKKGQLLLRRCLDAAMTRDLRPLANRLCALWKMWDQRIMTLLGHRRRAQGRRYKRA

SEQ ID NO: 4254 - protein, 34 aa, Artificial Sequence
  Computer-generated peptide variant
LMRLFHKLFRWLRTRHKYKLDAARQADHSWKLIL

SEQ ID NO: 4255 - protein, 24 aa, Artificial Sequence
  Computer-generated peptide variant
RYKLLNRYYKYFRKVAGKLLGCAR

SEQ ID NO: 4256 - protein, 72 aa, Artificial Sequence
  Computer-generated peptide variant
RLKLLRRLIKRLKCGAQKLAAATRLKRKARARRMMYKLDSYEHLHCPIMRQINPKKWLYKFCEYLWSYAAKH

SEQ ID NO: 4257 - protein, 61 aa, Artificial Sequence
  Computer-generated peptide variant
RFRLFKKLLKYWQRRLTTLKDESLGDFKREYDKLMKLRLRRLWAAKMSTKATGYKVLRAWM

SEQ ID NO: 4258 - protein, 90 aa, Artificial Sequence
  Computer-generated peptide variant
RLRLLPKMLRLLSRGGRAILGQYKARLNGRQLKHAYLAKKHHKRCDWLMMVIMLAKIRNCKNMNRLHERMLKLSKDRRLGLRRALVIKET

SEQ ID NO: 4259 - protein, 21 aa, Artificial Sequence
  Computer-generated peptide variant
WIKLLSKFFKFLKHYKPRKAL

SEQ ID NO: 4260 - protein, 47 aa, Artificial Sequence
  Computer-generated peptide variant
RLRLLCRIFKIFNKLAPSLWKAADHRKQPLVKRALPYTAKRWLRAAK

SEQ ID NO: 4261 - protein, 25 aa, Artificial Sequence
  Computer-generated peptide variant
IFRYFSRILKFFRKKANRANLAAKT

SEQ ID NO: 4262 - protein, 66 aa, Artificial Sequence
  Computer-generated peptide variant
RLKYLRRFIRKWKKLRQYLAAGNLKRLLLYPKVNVRTKKNAASGKFTKGCFLSRLLKANNSVKWDK

SEQ ID NO: 4263 - protein, 84 aa, Artificial Sequence
  Computer-generated peptide variant
RYRMLRKWFRLFKRKAKATLRAKKRALWGKRKNQHWRTEQSNKAAKLDQPIKPRDLNGVLARKTRREANVAKTWAASKYKANLS

SEQ ID NO: 4264 - protein, 25 aa, Artificial Sequence
  Computer-generated peptide variant
RLRLLKRLIRKFKCLSNDLRCFSGP

SEQ ID NO: 4265 - protein, 60 aa, Artificial Sequence
  Computer-generated peptide variant
KIRFFRKLYRFLNKRKASKDQRALEAEYRSLDKPAKRDLRISRHWPSLARFEAQCLARRV

SEQ ID NO: 4266 - protein, 28 aa, Artificial Sequence
  Computer-generated peptide variant
KFKILRRLLKRICTFANKPFRLLREADC

SEQ ID NO: 4267 - protein, 25 aa, Artificial Sequence
  Computer-generated peptide variant
LYRFLPKLYRRWKRAKYHFLDLLWI

SEQ ID NO: 4268 - protein, 22 aa, Artificial Sequence
  Computer-generated peptide variant
YWRMLRKLIRLYKNAFVLSARA

SEQ ID NO: 4269 - protein, 44 aa, Artificial Sequence
  Computer-generated peptide variant
KLKLWKRWLRKFKHAMRRGFLVLALRDVWRHPKRDSLMRAAMTR

SEQ ID NO: 4270 - protein, 97 aa, Artificial Sequence
  Computer-generated peptide variant
RLKFFCKFFRFLKQRGRMTSAALCQVQDRFVMWRKRLMTLCLYAIKAINCGSKAHLLAALRSNLLCIRRNARARANKVQKLLLEKYWKRLLKRKGRL

SEQ ID NO: 4271 - protein, 31 aa, Artificial Sequence
  Computer-generated peptide variant
LWRILRRMWRFLRRKPAKAIPTAAAKSHKDS

SEQ ID NO: 4272 - protein, 29 aa, Artificial Sequence
  Computer-generated peptide variant
RLKLIPRFIKIINSFRRARALLLRFINLG

SEQ ID NO: 4273 - protein, 71 aa, Artificial Sequence
  Computer-generated peptide variant
RFRFLNKLLKRWKRIAATRFFRKWLMLKMIAMGDAVSVVCAFKRKRKLMKKRARAALHTWGSMPALPADLK

SEQ ID NO: 4274 - protein, 40 aa, Artificial Sequence
  Computer-generated peptide variant
RWKWFKKLMKWFPKLDTAAMKREALAMTLANASTRKYLLM

SEQ ID NO: 4275 - protein, 36 aa, Artificial Sequence
  Computer-generated peptide variant
RMKLLHRLLRRLRPEKRGARLERSAKCRASFEAYKH

SEQ ID NO: 4276 - protein, 95 aa, Artificial Sequence
  Computer-generated peptide variant
LFRILKRLLRKFKRGREVDIMDLMGRAWPRAWMMAYKRKVQHAYLRRFLLKLMKVKALVLNCLAEHGLEMHFLNRHHLRLKKIAKRAKRRVCHKR

SEQ ID NO: 4277 - protein, 73 aa, Artificial Sequence
  Computer-generated peptide variant
LYKLITRFLKYYNKKRKVAWCVKRQARLRRAKRKGYGTQYKQAFAMLIYFLAEVKKKRLWRKMVLKAANPLKL

SEQ ID NO: 4278 - protein, 45 aa, Artificial Sequence
  Computer-generated peptide variant
FLKLLSKFMKKLRSARAYVQLWNNKRPRKKAWFRAWARKKWAAKS

SEQ ID NO: 4279 - protein, 62 aa, Artificial Sequence
  Computer-generated peptide variant
KMRLMTKLLRFMKTSLLKALRVRWRARAYWDKLLATAHRRWKSDQEIAYDRKVLGASVKGAA

SEQ ID NO: 4280 - protein, 25 aa, Artificial Sequence
  Computer-generated peptide variant
KLRLFRKWLRRLRKYGGPLDITAKA

SEQ ID NO: 4281 - protein, 54 aa, Artificial Sequence
  Computer-generated peptide variant
KYRLLTKLFKRLRHRLLVSIARGIWTQQKAMSRRLSLYAARIVTRIAKKAARKP

SEQ ID NO: 4282 - protein, 44 aa, Artificial Sequence
  Computer-generated peptide variant
RMRLWRRWWRYLKRKKGLWFCRRRAMKQAALLLMRLAWHVFLYL

SEQ ID NO: 4283 - protein, 48 aa, Artificial Sequence
  Computer-generated peptide variant
LWRYLRKLFKRLNHARFATPKLLLIPYAALDKANTRKVLRQVASTRWW

SEQ ID NO: 4284 - protein, 41 aa, Artificial Sequence
  Computer-generated peptide variant
RLRWWKKLIKRIKKIASRAGSARQLANDGIHLDLHLFRRAR

SEQ ID NO: 4285 - protein, 45 aa, Artificial Sequence
  Computer-generated peptide variant
RFKLICKILKLISHLGLKFGRLLRYFGAYLALKHAKTAKSALIGK

SEQ ID NO: 4286 - protein, 34 aa, Artificial Sequence
  Computer-generated peptide variant
RLRMIRKFIRKFCQQAYHMLVLLKAKAYALWNRK

SEQ ID NO: 4287 - protein, 38 aa, Artificial Sequence
  Computer-generated peptide variant
KFRLIKRLYKLFKHQAFLRARRIAFAIEAAAWALKKPL

SEQ ID NO: 4288 - protein, 42 aa, Artificial Sequence
  Computer-generated peptide variant
WWKLFQRWLRWLHKQHRANRQLAIRLIALFLLARCRWRLEKD

SEQ ID NO: 4289 - protein, 22 aa, Artificial Sequence
  Computer-generated peptide variant
KFRLYNKLYKRLPKMLARLKPL

SEQ ID NO: 4290 - protein, 68 aa, Artificial Sequence
  Computer-generated peptide variant
FIKLLSKLLRLIKRETRAKAKKSGLDNLLPFKFKVRRSRADRARRLHIAAQLGSMITAWLEKLCAALT

SEQ ID NO: 4291 - protein, 100 aa, Artificial Sequence
  Computer-generated peptide variant
WIKLLRKFLKMYQHDAEADEYSSVKSKKRLARFDFEYIVSSSLLKRAAKMLMARRRKCQAKLLRRYAPIKLIKKQVRAGEKLKRVLLLAWDTQAAKRPKL

SEQ ID NO: 4292 - protein, 31 aa, Artificial Sequence
  Computer-generated peptide variant
YLRYMNRLIKLLRTLRRLMHIKLARFAYWKT

SEQ ID NO: 4293 - protein, 75 aa, Artificial Sequence
  Computer-generated peptide variant
RFKYLKKWLKLLRKLRWEDALAHLELRWTSAPRRCAWCMLHPKARGLINKCLKKRHWPCELLHASALPYRAKYRS

SEQ ID NO: 4294 - protein, 32 aa, Artificial Sequence
  Computer-generated peptide variant
FLRFITRIMRKLTRDLMPMALAKEAAKARVLK

SEQ ID NO: 4295 - protein, 29 aa, Artificial Sequence
  Computer-generated peptide variant
WFRWLKRMFKRLPKQAADILKASKYLPKA

SEQ ID NO: 4296 - protein, 22 aa, Artificial Sequence
  Computer-generated peptide variant
RLRYLCKLMRRINNLLANLLKN

SEQ ID NO: 4297 - protein, 94 aa, Artificial Sequence
  Computer-generated peptide variant
RFRLWNKFYKKYKKKAWLLLAYFDYRKKMLLCEAYKAEQRFSDLHYKAKRKKVRCDQAAWRLIVKLRSKRLLLKGERHNKKLLKAMARLALNIR

SEQ ID NO: 4298 - protein, 67 aa, Artificial Sequence
  Computer-generated peptide variant
KLKFWRRFFKKLRRCLDRNFKALLRKRLNLWYRNMILAACAQRARCKLLKTKQKHLATLAILHVPKK

SEQ ID NO: 4299 - protein, 28 aa, Artificial Sequence
  Computer-generated peptide variant
KLRLFCKYYRLFRSKGTLALKCASKLKL

SEQ ID NO: 4300 - protein, 60 aa, Artificial Sequence
  Computer-generated peptide variant
LLKLLRRFMRKIPHLHAVGARKPKYMRSAMALFIKKIGIKNFSRKKAAKAKPRKLLVGLW

SEQ ID NO: 4301 - protein, 61 aa, Artificial Sequence
  Computer-generated peptide variant
FLRMMRKFLRFLRKNKLVRDEGRHYALKVNHWAALRIKHRAQNLLILKSRPHAKRTALLNV

SEQ ID NO: 4302 - protein, 36 aa, Artificial Sequence
  Computer-generated peptide variant
LYRIYTKLLRLWKRLKRKKLKLKAAAKFGKFTHLAT

SEQ ID NO: 4303 - protein, 23 aa, Artificial Sequence
  Computer-generated peptide variant
KLRLLTKLFKWLCKTADIWKCCK

SEQ ID NO: 4304 - protein, 32 aa, Artificial Sequence
  Computer-generated peptide variant
RFRFFSRYMRLMKRHKAAILAFKLRTLHLKRH

SEQ ID NO: 4305 - protein, 37 aa, Artificial Sequence
  Computer-generated peptide variant
FYKLLRKILRKLKQLWLQVARQRTGRVHLNRAKNMWK

SEQ ID NO: 4306 - protein, 40 aa, Artificial Sequence
  Computer-generated peptide variant
RFKFWKKLLRLLKQMRLHTKAFRARQAGDRYPMIRGCDAR

SEQ ID NO: 4307 - protein, 38 aa, Artificial Sequence
  Computer-generated peptide variant
MLRFIRKLFRRFCTYSRTLPVAKKAMLKHLLAKLSRVH

SEQ ID NO: 4308 - protein, 36 aa, Artificial Sequence
  Computer-generated peptide variant
RYKILKRFLKRFRCFAQKALLANYMKLKALMISRLC

SEQ ID NO: 4309 - protein, 45 aa, Artificial Sequence
  Computer-generated peptide variant
KLKLWKRIMKRLRPRLHAKDVPKKEVVVLWKMVLLMQLNLANRAA

SEQ ID NO: 4310 - protein, 49 aa, Artificial Sequence
  Computer-generated peptide variant
KMRMLKRLLRKWRNVTPFFYALLRLLARHSDVLVKLGLLWVLARAKKAG

SEQ ID NO: 4311 - protein, 49 aa, Artificial Sequence
  Computer-generated peptide variant
KLRFFPKWLKLLQTSYRLKAMRPKRLRWCIFKRKRFHKMLKSLAFMLFA

SEQ ID NO: 4312 - protein, 20 aa, Artificial Sequence
  Computer-generated peptide variant
KLRLYKKLWRFMKPALAQTF

SEQ ID NO: 4313 - protein, 29 aa, Artificial Sequence
  Computer-generated peptide variant
RLRLLRKILKKWRNWMNHKHRALAQANTR

SEQ ID NO: 4314 - protein, 47 aa, Artificial Sequence
  Computer-generated peptide variant
YLKIITRLWRYLQRGMTKTRDPPVALAKLDAKTAAAEAAKARQESAK

SEQ ID NO: 4315 - protein, 21 aa, Artificial Sequence
  Computer-generated peptide variant
YLRFYNRFLKKLRNLAKYAKA

SEQ ID NO: 4316 - protein, 28 aa, Artificial Sequence
  Computer-generated peptide variant
RMKWYSKLLKYFRRKAAKACSIVGLAYA

SEQ ID NO: 4317 - protein, 54 aa, Artificial Sequence
  Computer-generated peptide variant
KFKLWKKYMRLFKRIWKLLKWKDHSLHKLARKEHLAARLAAKTVQARCSAPNKK

SEQ ID NO: 4318 - protein, 57 aa, Artificial Sequence
  Computer-generated peptide variant
KMKILKRFFRYLRRRYRYAPLACPIAACKYRLKHKPLRALDPLLIQLEKAPIAEGIK

SEQ ID NO: 4319 - protein, 27 aa, Artificial Sequence
  Computer-generated peptide variant
RFKMITKLLRRMTKLGETVLRRLWTLL

SEQ ID NO: 4320 - protein, 96 aa, Artificial Sequence
  Computer-generated peptide variant
RYKLMRKLLKMLKNKIWSLALCKEKNLMVGRKLLAALLALWNTHWRTKRLYPKLAWRNAMARRVRAKRHIYKNGHTKLLHLGVNCTRTYKLIAKKL

SEQ ID NO: 4321 - protein, 66 aa, Artificial Sequence
  Computer-generated peptide variant
MFKLIKRYIRKWKKQFAILQHVRLCLRQREVLELCMAYRAWRAKRKKKKLFNRWMLKLWAKAAMLT

SEQ ID NO: 4322 - protein, 47 aa, Artificial Sequence
  Computer-generated peptide variant
RFKLLSRLFKKLKCANLLLCALSRRKYLHVGIAYYVKLDKRAATLKF

SEQ ID NO: 4323 - protein, 34 aa, Artificial Sequence
  Computer-generated peptide variant
YWKFMKKFFRKLCRDESALATKKRALRCRMLLSY

SEQ ID NO: 4324 - protein, 41 aa, Artificial Sequence
  Computer-generated peptide variant
RLKYMHRLLRKWRNGLNSYALFKFRRWKRRKLYSELKFAYA

SEQ ID NO: 4325 - protein, 86 aa, Artificial Sequence
  Computer-generated peptide variant
YIRYLKKFMRLINPPGRRSKRSELYQSAKEARRAEGYARHKRGQLNLLYRKRCALCFKRLLLVARRKKKLKMLYEVAAGAQKLKKI

SEQ ID NO: 4326 - protein, 41 aa, Artificial Sequence
  Computer-generated peptide variant
KYRIIKKWYRKLRQASQKELLRAEACLAVVRMALGKPRLNP

SEQ ID NO: 4327 - protein, 40 aa, Artificial Sequence
  Computer-generated peptide variant
RLRLMQRLLRKFKRKVLHALSRRPGWMLCRFEETKPALRS

SEQ ID NO: 4328 - protein, 48 aa, Artificial Sequence
  Computer-generated peptide variant
FFKILKRLLKKFKHALKHFKRYHACECIRFCLARLYAHKAAKKSLMRK

SEQ ID NO: 4329 - protein, 38 aa, Artificial Sequence
  Computer-generated peptide variant
LLRLWRRLFKMLRCCRYQRWIRWKDKYNRVPAKALLLQ

SEQ ID NO: 4330 - protein, 24 aa, Artificial Sequence
  Computer-generated peptide variant
RLKILQKYLKKWRKNSASMLLLYY

SEQ ID NO: 4331 - protein, 100 aa, Artificial Sequence
  Computer-generated peptide variant
LMRLYRRIYKLLKRLRLAMALNSLDRRLIRAKNDEDAHRRKKENDTDNKADHAIFKTRNKALNGQPCERLWPYAIAFLGLKLRCRSLLERKALQLAAMNS

SEQ ID NO: 4332 - protein, 26 aa, Artificial Sequence
  Computer-generated peptide variant
MLKFFTKYYKLLKKARVRRNKAQHLL

SEQ ID NO: 4333 - protein, 32 aa, Artificial Sequence
  Computer-generated peptide variant
KLRIYQRFLKKFKRLNPILRAHRLWHRGELLC

SEQ ID NO: 4334 - protein, 52 aa, Artificial Sequence
  Computer-generated peptide variant
KLKIWSRLLKKMHKHATARVLTANVLLNLYTASLALKCPRKKPFKEMAFARQ

SEQ ID NO: 4335 - protein, 30 aa, Artificial Sequence
  Computer-generated peptide variant
KLRFIRKFFKKWPKTKTLAYSKITLAALKL

SEQ ID NO: 4336 - protein, 39 aa, Artificial Sequence
  Computer-generated peptide variant
YLKLWKRLLKRLSKKAKTNVFCTKAIHQLNMRLKIEKLL

SEQ ID NO: 4337 - protein, 31 aa, Artificial Sequence
  Computer-generated peptide variant
KWKLWNRLIKRLQRRLHWALALLWRKGSKRI

SEQ ID NO: 4338 - protein, 59 aa, Artificial Sequence
  Computer-generated peptide variant
RWRWLNKLLRRFCCRKARELLRDKLTLNALQKRLVLMPIMAMKRVSRFRRLCLKNAFAV

SEQ ID NO: 4339 - protein, 28 aa, Artificial Sequence
  Computer-generated peptide variant
LWKMIKKLIKLLKKKRTYACLALSFIHS

SEQ ID NO: 4340 - protein, 46 aa, Artificial Sequence
  Computer-generated peptide variant
FLKFICRLWKKWKRHSWALKCLKRAIKKWVKQLAYRPAAKEIAAKD

SEQ ID NO: 4341 - protein, 39 aa, Artificial Sequence
  Computer-generated peptide variant
WYRILKRIMRKLKHLALAHAKMTRRRLHAELTAAVIRIN

SEQ ID NO: 4342 - protein, 69 aa, Artificial Sequence
  Computer-generated peptide variant
LIKYFKKWLRRMRKLLIRDLKKRLLQALMIQLMRRELERNKDITEDLRAHLPAIPRSHAARAKALLLQK

SEQ ID NO: 4343 - protein, 67 aa, Artificial Sequence
  Computer-generated peptide variant
KIRYFRKLLRRIKKLLCRKAPLAVLYMWPADTQKDILRILRALKNYRIAAKCKAGPFRHEMQARQML

SEQ ID NO: 4344 - protein, 26 aa, Artificial Sequence
  Computer-generated peptide variant
LLKLMCRYYKLLHRRERLLCKKLWHR

SEQ ID NO: 4345 - protein, 28 aa, Artificial Sequence
  Computer-generated peptide variant
LIKLLSRLFKYIHKSQNLAHKLLLRKKV

SEQ ID NO: 4346 - protein, 26 aa, Artificial Sequence
  Computer-generated peptide variant
MFKLYNKLFRKLRKELQALPQNARLE

SEQ ID NO: 4347 - protein, 80 aa, Artificial Sequence
  Computer-generated peptide variant
KLKWLRKWLKRLNRDMPTPTWMALKTAKKKLAARKHNHKIRHWILTGLTCYEHLQKKLKTRWAIMLNARAGARKRMKVDA

SEQ ID NO: 4348 - protein, 43 aa, Artificial Sequence
  Computer-generated peptide variant
YWRLMSRMMKILRKTEPAMIRLAKRAKIKIFMAAKRSMRLAAI

SEQ ID NO: 4349 - protein, 34 aa, Artificial Sequence
  Computer-generated peptide variant
KYRFIHRLYRRFKTAIRLMKARKYTCAKALATYA

SEQ ID NO: 4350 - protein, 35 aa, Artificial Sequence
  Computer-generated peptide variant
KFRLLNRYLRKLKRRLKPCKHHLKAALCHHVKKVA

SEQ ID NO: 4351 - protein, 71 aa, Artificial Sequence
  Computer-generated peptide variant
LLKLMCRLLKLLTPLAYCAMLLGKCTRANRYLLTLLRRAWARREWRATLRKKKKIKECIRRKNCHANKALR

SEQ ID NO: 4352 - protein, 25 aa, Artificial Sequence
  Computer-generated peptide variant
YMKFYRRYLRKLSTEDKLCRAAWKA

SEQ ID NO: 4353 - protein, 55 aa, Artificial Sequence
  Computer-generated peptide variant
WYKMLCKFFRRFQKWDKALALRKYKRRLKENAHNLELKRALARRGLQMTYDAHYL

SEQ ID NO: 4354 - protein, 65 aa, Artificial Sequence
  Computer-generated peptide variant
KMKLLRKLLRLLKQRDLWLKPIELRNYRLKKIRQKLRQMGKSEVCKCIIGLSLAEKPLKHYQMLL

SEQ ID NO: 4355 - protein, 32 aa, Artificial Sequence
  Computer-generated peptide variant
RYKLLRRFIRLLPKVDYCRAILKHQGFRLANK

SEQ ID NO: 4356 - protein, 70 aa, Artificial Sequence
  Computer-generated peptide variant
MLRFIKRFIKKLHNSRLWRLTLNNLYAMKWLLARRQCTKLICAFPRCGAKRQRPCARTRNKIARRPAARR

SEQ ID NO: 4357 - protein, 40 aa, Artificial Sequence
  Computer-generated peptide variant
YLKFYRRFMKLLRCGVAELRKRRFARNARARLRLMLWLLK

SEQ ID NO: 4358 - protein, 26 aa, Artificial Sequence
  Computer-generated peptide variant
KFRLLNKYIRRFRTEILKAKLAYMAT

SEQ ID NO: 4359 - protein, 22 aa, Artificial Sequence
  Computer-generated peptide variant
LLKLLRKIFRRFRKRHGEEALM

SEQ ID NO: 4360 - protein, 49 aa, Artificial Sequence
  Computer-generated peptide variant
LIRFFQKILKRLCRRYMKKKILARLRKGNTAAAIMKHDAAKKKELECWS

SEQ ID NO: 4361 - protein, 30 aa, Artificial Sequence
  Computer-generated peptide variant
RLRFWTRFIKRFRSKLAAWRLKRGLMAANH

SEQ ID NO: 4362 - protein, 20 aa, Artificial Sequence
  Computer-generated peptide variant
LFRLMSKWIRILRRSELKAF

SEQ ID NO: 4363 - protein, 38 aa, Artificial Sequence
  Computer-generated peptide variant
RLKWLKRLFKRIRRRLNSGLTNLQKRAAVLRAGQYILW

SEQ ID NO: 4364 - protein, 25 aa, Artificial Sequence
  Computer-generated peptide variant
KWRILKKYLRMFRKTALKMIAKLYA

SEQ ID NO: 4365 - protein, 58 aa, Artificial Sequence
  Computer-generated peptide variant
MLKMFKRLWRRIKTMLARWRLKYKCLKARMKLYLKLVRHKVWAANAYAELECNLASGA

SEQ ID NO: 4366 - protein, 52 aa, Artificial Sequence
  Computer-generated peptide variant
RLRYFNKWWRLFKKFLVRRDLRATSHLVEANELAKVRKTARKKENAARDHAW

SEQ ID NO: 4367 - protein, 40 aa, Artificial Sequence
  Computer-generated peptide variant
KFRLLKRLLKRWKRLLLYKANKIKCGDKVPMNLWMKMFAR

SEQ ID NO: 4368 - protein, 58 aa, Artificial Sequence
  Computer-generated peptide variant
YFKWFQRLFKRLKCAMKDRRIKRLKLKTHYRLMSARRLGDAMKSCLEARLFAAEFRPK

SEQ ID NO: 4369 - protein, 42 aa, Artificial Sequence
  Computer-generated peptide variant
RYKLFCKLWKFMRRWNACAAKKDTEIGAKRAARIRGATAKLQ

SEQ ID NO: 4370 - protein, 21 aa, Artificial Sequence
  Computer-generated peptide variant
FWRLLNKMIKKFKPLREAVKA

SEQ ID NO: 4371 - protein, 33 aa, Artificial Sequence
  Computer-generated peptide variant
LFRFLQKMLRRYHQERHLVEVKAKKAFCALRAR

SEQ ID NO: 4372 - protein, 33 aa, Artificial Sequence
  Computer-generated peptide variant
RWKLLPKLIKRLRRAKAATKALHHAKNRRMHII

SEQ ID NO: 4373 - protein, 32 aa, Artificial Sequence
  Computer-generated peptide variant
ILKFLKRMLRRFQKQSEVVEEKHLLAKLLKVL

SEQ ID NO: 4374 - protein, 91 aa, Artificial Sequence
  Computer-generated peptide variant
RYRFWKKLIRFLKRLLAFRTRARLRKATATLLPRKRLKADLRAALRMTTPRLSSQKQAEFKTETCCSARATKKDRLKIRRALMCLARLRPW

SEQ ID NO: 4375 - protein, 27 aa, Artificial Sequence
  Computer-generated peptide variant
KLKFIRRLWKKWKTLARLYLACTYRNC

SEQ ID NO: 4376 - protein, 49 aa, Artificial Sequence
  Computer-generated peptide variant
LLKLLQKWWKRWCCEDKKALVLLAFVCAQKAKRMFHNRRRLENESANAL

SEQ ID NO: 4377 - protein, 28 aa, Artificial Sequence
  Computer-generated peptide variant
RFRWFCRIMRRFRRALKCAALALRLIEL

SEQ ID NO: 4378 - protein, 23 aa, Artificial Sequence
  Computer-generated peptide variant
RFKFLKKLFRLLTRKQYLAKRFA

SEQ ID NO: 4379 - protein, 37 aa, Artificial Sequence
  Computer-generated peptide variant
RMRWLNKIFKRIKKHRFCLRSHLFLLRAKLAALMDEM

SEQ ID NO: 4380 - protein, 24 aa, Artificial Sequence
  Computer-generated peptide variant
KFKLMNRILKILKKELMSDGRLLK

SEQ ID NO: 4381 - protein, 82 aa, Artificial Sequence
  Computer-generated peptide variant
FLKLLPRWFRKYNRARYLKRRCWLALHLLRPSRLDLDLGVHACFKLVKLPGAKKPKARKTPKLHSAGKLRYRSHQQARMRYK

SEQ ID NO: 4382 - protein, 33 aa, Artificial Sequence
  Computer-generated peptide variant
KMRMLRKLYKKWKHRLHLRKALAMHHALHKTAA

SEQ ID NO: 4383 - protein, 30 aa, Artificial Sequence
  Computer-generated peptide variant
WWKIYRRLLRLIRRAQKGKAKRRETEADAA

SEQ ID NO: 4384 - protein, 58 aa, Artificial Sequence
  Computer-generated peptide variant
RLRWIRRLMRRWSNFLLRKLLILGIYPEALVSTHTWARALKARNRVRFRKEALDLCAK

SEQ ID NO: 4385 - protein, 34 aa, Artificial Sequence
  Computer-generated peptide variant
MIRWMRKLMKKLRKWKSYAKLLRKSLLRAANLPG

SEQ ID NO: 4386 - protein, 56 aa, Artificial Sequence
  Computer-generated peptide variant
WMKWIKKLIKRLTRKKLTQKQLFLPHKAALFFKKDWTRPRATDRAKFAAGLAMYIR

SEQ ID NO: 4387 - protein, 40 aa, Artificial Sequence
  Computer-generated peptide variant
KFRLITKLLRKWRKLRNRDSLALSKRLSTRMAKKFPTWIA

SEQ ID NO: 4388 - protein, 83 aa, Artificial Sequence
  Computer-generated peptide variant
LLRLISRLWRRLSNWHQVHEREALGRKLAEADFPLLKAERSLKDALLKALLGKLAQKKASAAWAKSRAAPVAKTKTRIMRSRH

SEQ ID NO: 4389 - protein, 63 aa, Artificial Sequence
  Computer-generated peptide variant
KIRLYRRFLRKWKHIGAMKAEARIMYELRKFLMCKKLIARAKQAAYRSLWKLTAWSRVRKWYV

SEQ ID NO: 4390 - protein, 20 aa, Artificial Sequence
  Computer-generated peptide variant
LLKWFCKLLKFLRNPRYCKL

SEQ ID NO: 4391 - protein, 43 aa, Artificial Sequence
  Computer-generated peptide variant
LWRLFPKYFRRMRPTLALKLIEKRRPHSALEAANAPNTLRSKL

SEQ ID NO: 4392 - protein, 54 aa, Artificial Sequence
  Computer-generated peptide variant
RFKLFKRLFRRIRTKAAFQRMQKRAYPLPCLRSAAFLLNACWRDIAVLKLGRAE

SEQ ID NO: 4393 - protein, 34 aa, Artificial Sequence
  Computer-generated peptide variant
IFRFLCKLLRLYQRKQCALRLLFKKRTWKQYMIR

SEQ ID NO: 4394 - protein, 89 aa, Artificial Sequence
  Computer-generated peptide variant
RWKLLCKLLRRMRRKDQHRVRYFENAGLMLRKGKDYKEIARGVSLRLRALAMALPRRSELWDARRRPWLSITLRLSALMKYARKYTLNW

SEQ ID NO: 4395 - protein, 50 aa, Artificial Sequence
  Computer-generated peptide variant
LYRYYKRLIRKLNKLEVAERLLKRELCRTLFFKLRRHHAGCKKDHGKAEC

SEQ ID NO: 4396 - protein, 22 aa, Artificial Sequence
  Computer-generated peptide variant
RLRILNRYLRWYKRLIDAFMLA

SEQ ID NO: 4397 - protein, 97 aa, Artificial Sequence
  Computer-generated peptide variant
YIKLLKRFLKRIKKRDCNRLNQGLNHRMQMTKLIKLAVLWKLFKAVALRRYRSRDRLCCLKHLNAKFITRKLAKRLSFRRQNLLTDCAKMAKFKKPA

SEQ ID NO: 4398 - protein, 51 aa, Artificial Sequence
  Computer-generated peptide variant
ILKWFRRFLRRWRRRNRGMAAAAKNYFLQNKKDKRLLFSLDLVLGFALKTG

SEQ ID NO: 4399 - protein, 30 aa, Artificial Sequence
  Computer-generated peptide variant
FLKLLKRLLKIYHKKRFCANCKHQAVGLAY

SEQ ID NO: 4400 - protein, 45 aa, Artificial Sequence
  Computer-generated peptide variant
RLKWLRKMLRKWCKIRKVVDEKKRYLVKFCKLALRAAWLTAMSDW

SEQ ID NO: 4401 - protein, 32 aa, Artificial Sequence
  Computer-generated peptide variant
KLRWLRRLWKRLKRRIIVDAAARSKQFQASGQ

SEQ ID NO: 4402 - protein, 77 aa, Artificial Sequence
  Computer-generated peptide variant
RWKLIHKMLKKFKHLLFRLKRLERRKKQNATFFYDPHCACWAKARESLAARKHDKNQLFYRKDMARRWLRLREMLRQ

SEQ ID NO: 4403 - protein, 44 aa, Artificial Sequence
  Computer-generated peptide variant
MFKWFKKLLKLMCRIKLLQIERRQTRVFDGLKFLKLRRKAALDG

SEQ ID NO: 4404 - protein, 40 aa, Artificial Sequence
  Computer-generated peptide variant
LMKFLCRLLRRFKSYIMKHTLRLWRKRLQSITKLCNNLKA

SEQ ID NO: 4405 - protein, 22 aa, Artificial Sequence
  Computer-generated peptide variant
LIKMWRKWLKRMPKLAEPRLWA

SEQ ID NO: 4406 - protein, 66 aa, Artificial Sequence
  Computer-generated peptide variant
KYRMLCRLLKRWNRIEMKAARLGADIMKRALKNTADQSEWKAAFGAFKKALAAQKALKAAKSFCPA

SEQ ID NO: 4407 - protein, 46 aa, Artificial Sequence
  Computer-generated peptide variant
LFKFLNKWMKRFKKLKARFSWYLAQLAAGDAALSRYLRFVRRTAML

SEQ ID NO: 4408 - protein, 39 aa, Artificial Sequence
  Computer-generated peptide variant
LYKLLKRLWRKLQRYFHRNMLADDAEFSKTRKLGLSARK

SEQ ID NO: 4409 - protein, 40 aa, Artificial Sequence
  Computer-generated peptide variant
KLKFLTKWLKYWKTAKWAQARFRDNLRANRLRVLFAARFL

SEQ ID NO: 4410 - protein, 21 aa, Artificial Sequence
  Computer-generated peptide variant
RIKLWRKFLRKFKSSMLLSLQ

SEQ ID NO: 4411 - protein, 33 aa, Artificial Sequence
  Computer-generated peptide variant
RLKFYRRLYKMYRKQAGRRGHRWRLLQFFLVAL

SEQ ID NO: 4412 - protein, 21 aa, Artificial Sequence
  Computer-generated peptide variant
RLKMFQRLMRKLNKCKFHHLL

SEQ ID NO: 4413 - protein, 98 aa, Artificial Sequence
  Computer-generated peptide variant
LMKLLKKLLKRWQNKANLAFAFDATGQKLLKALRWNKQRHHGRDRARTRKRAALRKRRTTNQQKAFHAYRMDFWDSLTAGEMLRLRRLAHQLGKNTAM

SEQ ID NO: 4414 - protein, 20 aa, Artificial Sequence
  Computer-generated peptide variant
RLKLWNKMIKRLKQSWAAWC

SEQ ID NO: 4415 - protein, 40 aa, Artificial Sequence
  Computer-generated peptide variant
YIKLYCRMFKRIRRCASTGALNAYKLRFVQHKAHLLLKLK

SEQ ID NO: 4416 - protein, 58 aa, Artificial Sequence
  Computer-generated peptide variant
RLKYYKRLIKIFHKNKSFRGGTMRWYKCRRALELLLWKLKAMARRLAAHVAAPLGIAP

SEQ ID NO: 4417 - protein, 25 aa, Artificial Sequence
  Computer-generated peptide variant
LLKFLCKLFKWLHCKLRVNKQLVKR

SEQ ID NO: 4418 - protein, 36 aa, Artificial Sequence
  Computer-generated peptide variant
LLRLWRRLLKKYKHLDMFQWAKCRKLKTWAHAGIFI

SEQ ID NO: 4419 - protein, 35 aa, Artificial Sequence
  Computer-generated peptide variant
LFRLMKRFLRIFRQLGGHKQAHALWRRDLARAKMA

SEQ ID NO: 4420 - protein, 54 aa, Artificial Sequence
  Computer-generated peptide variant
KFKLFSRLFRKFKSYRRGKYDRPAVDSAMLARLLARLKKNVKGARLTERPTGEA

SEQ ID NO: 4421 - protein, 20 aa, Artificial Sequence
  Computer-generated peptide variant
WYRMLPKILKLLRHLRDLAF

SEQ ID NO: 4422 - protein, 46 aa, Artificial Sequence
  Computer-generated peptide variant
RFKYFRKLLRRLTKMDMAWVKLWLLLSWKRELCLLKWLEAKQTAKI

SEQ ID NO: 4423 - protein, 25 aa, Artificial Sequence
  Computer-generated peptide variant
ILRLYCRLLKIMKRWDLKAKLSVIK

SEQ ID NO: 4424 - protein, 84 aa, Artificial Sequence
  Computer-generated peptide variant
KLRFYRKLLRKMCQKCWKRERKSAEKLLAAMRAKRRAAACNKRARAMSNNQLEANQRFRAKTVECPRTLALLKLNPARRALRDA

SEQ ID NO: 4425 - protein, 27 aa, Artificial Sequence
  Computer-generated peptide variant
RLRFWTKMLRKLRKLKLASAAALRRFK

SEQ ID NO: 4426 - protein, 59 aa, Artificial Sequence
  Computer-generated peptide variant
RWRLMRRFFRLYKKLINKRVLPCLPAKATAREPARCSLAMEDIRNVKKLEAWALLGMKR

SEQ ID NO: 4427 - protein, 48 aa, Artificial Sequence
  Computer-generated peptide variant
KFKFLCKFFKKLQKAEEAHRVVPLQALTRARSLAKCACLYRLLKSKKQ

SEQ ID NO: 4428 - protein, 29 aa, Artificial Sequence
  Computer-generated peptide variant
LLKLLRKWLRKLRRRAGAPSHPMVAQVIK

SEQ ID NO: 4429 - protein, 36 aa, Artificial Sequence
  Computer-generated peptide variant
MMKMWKKLFRILKRCKPLLKLHWNLERAADWRRLES

SEQ ID NO: 4430 - protein, 31 aa, Artificial Sequence
  Computer-generated peptide variant
RYKFLHRMFKLLNRANIKLRWMLERKRAACA

SEQ ID NO: 4431 - protein, 21 aa, Artificial Sequence
  Computer-generated peptide variant
RYKFFQKLLKRFRPHYLLDKA

SEQ ID NO: 4432 - protein, 37 aa, Artificial Sequence
  Computer-generated peptide variant
RLRFFKRIYKFFRKLLWPDLCTDALGLLALQRHLRML

SEQ ID NO: 4433 - protein, 29 aa, Artificial Sequence
  Computer-generated peptide variant
LLKFWRKLMKYMRRAVLPAALQKCKTAKT

SEQ ID NO: 4434 - protein, 23 aa, Artificial Sequence
  Computer-generated peptide variant
LFKLLRRLIRKFKRRASKLALRA

SEQ ID NO: 4435 - protein, 20 aa, Artificial Sequence
  Computer-generated peptide variant
YLRLFRRFYKRLSSTSLLER

SEQ ID NO: 4436 - protein, 41 aa, Artificial Sequence
  Computer-generated peptide variant
LLRIYKKFLRFLNKALKRYPLKHRWKIACWNLRFASRLKFL

SEQ ID NO: 4437 - protein, 74 aa, Artificial Sequence
  Computer-generated peptide variant
KMRWIKRLLRRLQRIPLLLALAKLFACDEADAPKLFVRMNRVYKYDYNRSLLLPVRRTRARARLFPKRHFLIAR

SEQ ID NO: 4438 - protein, 29 aa, Artificial Sequence
  Computer-generated peptide variant
FLKMWHKLIRFLKKFAMKKNSAKLTELGR

SEQ ID NO: 4439 - protein, 30 aa, Artificial Sequence
  Computer-generated peptide variant
FLRLYRRFIRRFHSRLLLHKDLRWKLLPRI

SEQ ID NO: 4440 - protein, 50 aa, Artificial Sequence
  Computer-generated peptide variant
WLRLMTKLYKMFRQMSALKNAKRRALKVDKPARLSKALKRWSVNARGLNR

SEQ ID NO: 4441 - protein, 73 aa, Artificial Sequence
  Computer-generated peptide variant
KLKWIRRYFKLFQKMKAKSKPCKMDRPAAQHCRVTLQLHARRRLLQMEKRKRLKVMDAAHFAERRDTAAYLLK

SEQ ID NO: 4442 - protein, 20 aa, Artificial Sequence
  Computer-generated peptide variant
RIRMFNRWLRRLKHYLAKLY

SEQ ID NO: 4443 - protein, 81 aa, Artificial Sequence
  Computer-generated peptide variant
FLKMLRKMLRKYRQPLKRGHKRAAKKKNTLKLYAISMAWAMKRRIKLLCWAISAKPGDWKRRAYRLNAAQKAPDAVQEKRH

SEQ ID NO: 4444 - protein, 86 aa, Artificial Sequence
  Computer-generated peptide variant
KYRFLQKFLKILRPLKFIPAANLRSAQRCYRLCMIDAAEKNRAIGLHPKHAAMCHLRRFKRRPALLEMARRSRFINKKRLLLAKRH

SEQ ID NO: 4445 - protein, 64 aa, Artificial Sequence
  Computer-generated peptide variant
RFKILKRLLRLLHPNKATLKARATMQRKEKYYSLELAWHKAPDAKMRVLRVLLKMLSEKAAALA

SEQ ID NO: 4446 - protein, 20 aa, Artificial Sequence
  Computer-generated peptide variant
KLKLLHRMYRKFCKAVWLKQ

SEQ ID NO: 4447 - protein, 100 aa, Artificial Sequence
  Computer-generated peptide variant
YIRLLCRLMKLLCCERKAISEDSVLKANLRLYLRLPSLELLLKKNWNKAPRADKALMRLENMLIFCIDRQLAFCKLRVQRGKMKMAKKRLAQAATTGPKA

SEQ ID NO: 4448 - protein, 21 aa, Artificial Sequence
  Computer-generated peptide variant
RYKMLCRLLKRLNRLLFTKPK

SEQ ID NO: 4449 - protein, 25 aa, Artificial Sequence
  Computer-generated peptide variant
RWRYLKRYLKLLPKAKAKRLWDADN

SEQ ID NO: 4450 - protein, 63 aa, Artificial Sequence
  Computer-generated peptide variant
KFKFMHKLLRYLHKDPPLAKYFDNPAAALRKARITCKRRAWKKAARAYQEMAIARAWRWLTHF

SEQ ID NO: 4451 - protein, 43 aa, Artificial Sequence
  Computer-generated peptide variant
YLKLFQKFFRFYRRKLLKRSALYLNLLALLRCKLLCKHDPQMR

SEQ ID NO: 4452 - protein, 44 aa, Artificial Sequence
  Computer-generated peptide variant
KLKMYCRWWKLIKNALRRVAWAALLDAKKTKQAHKHFKVWLKLY

SEQ ID NO: 4453 - protein, 45 aa, Artificial Sequence
  Computer-generated peptide variant
LLRIIKRLMRMWPSKKRWLAAAYKFLMCAVKRMLLPSDRAEAADS

SEQ ID NO: 4454 - protein, 58 aa, Artificial Sequence
  Computer-generated peptide variant
FLKLLTKWFKRFSKILKRLLLVKFGDTRDAQLRNAAKTMNKARFRTCLASPRRKEHKR

SEQ ID NO: 4455 - protein, 35 aa, Artificial Sequence
  Computer-generated peptide variant
KLKILKRLLKLLRNLKVNKPALMQLRGHEAKRRCP

SEQ ID NO: 4456 - protein, 36 aa, Artificial Sequence
  Computer-generated peptide variant
KIRLITRFMKKLHKAWLDIKGAVARKGAKGHLKLLW

SEQ ID NO: 4457 - protein, 26 aa, Artificial Sequence
  Computer-generated peptide variant
FWKYLRRLFRFLKKRLILKTAKSAGS

SEQ ID NO: 4458 - protein, 26 aa, Artificial Sequence
  Computer-generated peptide variant
RLRILNRFIRKIRKKLALGKLSICLL

SEQ ID NO: 4459 - protein, 45 aa, Artificial Sequence
  Computer-generated peptide variant
RFKLLKRILRLLQRKLLCAPDFIATKASDIIAKAKGHKPRCWQRF

SEQ ID NO: 4460 - protein, 62 aa, Artificial Sequence
  Computer-generated peptide variant
RLKYMKRLMKKFKRKLASKLLHARGLIRNAVFTRRAEMAIANGDNLCFRRKMLRQAHKTMAG

SEQ ID NO: 4461 - protein, 66 aa, Artificial Sequence
  Computer-generated peptide variant
FIRLLHRIWRRFKRLDTKYAALNSRDKKACLLLDYRFALAARYSRPLYHQRAKKRNNNATAIKQRL

SEQ ID NO: 4462 - protein, 31 aa, Artificial Sequence
  Computer-generated peptide variant
WLKLLRRLFRRMNKPMQRAAGKDPSKWAKYA

SEQ ID NO: 4463 - protein, 36 aa, Artificial Sequence
  Computer-generated peptide variant
RFRIFHRLFKRLKCLLLAKLNQLILIDKAVYKEEHK

SEQ ID NO: 4464 - protein, 27 aa, Artificial Sequence
  Computer-generated peptide variant
RIRWFCKLLRLLRKALPHYLNKVAGRR

SEQ ID NO: 4465 - protein, 76 aa, Artificial Sequence
  Computer-generated peptide variant
LWKLYHRFFRKLRPDKRPRIFKAAAAVTPTLLLYWACKDAKKKKACDLTRRSAKKGLKLYRWTAVMRLGPASGLLG

SEQ ID NO: 4466 - protein, 49 aa, Artificial Sequence
  Computer-generated peptide variant
KLRILNKFMRLYRRGCVDLKLLWWRKLEKLQVKLAATTLKHDAFALRSL

SEQ ID NO: 4467 - protein, 32 aa, Artificial Sequence
  Computer-generated peptide variant
FFRFFKRLLRRMKKVDYWLVRAALLIYDLSRL

SEQ ID NO: 4468 - protein, 24 aa, Artificial Sequence
  Computer-generated peptide variant
IFKYLKKFFRLLKKADVAKQAIMR

SEQ ID NO: 4469 - protein, 50 aa, Artificial Sequence
  Computer-generated peptide variant
LFRYLKRLLRRLPKCNYMPAKRANFRALLLARCAYVEKPKAKRAIKNYKL

SEQ ID NO: 4470 - protein, 33 aa, Artificial Sequence
  Computer-generated peptide variant
KFKLLRKMLRRLTCLILGIPWIKKCMCKALRTL

SEQ ID NO: 4471 - protein, 22 aa, Artificial Sequence
  Computer-generated peptide variant
YMRMFKRYLKKLHKALNLRAAN

SEQ ID NO: 4472 - protein, 43 aa, Artificial Sequence
  Computer-generated peptide variant
KWKLLKKLMRLMRRVEAESLAANAEWPWVLKGRWRDALFLFCL

SEQ ID NO: 4473 - protein, 37 aa, Artificial Sequence
  Computer-generated peptide variant
YFKLLKRYLKRLCHAKKNKRAMKTKQLGSTSLSMELK

SEQ ID NO: 4474 - protein, 37 aa, Artificial Sequence
  Computer-generated peptide variant
MLRLMSKFWRRLKPALKYYARLYLRLKLKLSFRKRMW

SEQ ID NO: 4475 - protein, 42 aa, Artificial Sequence
  Computer-generated peptide variant
YWRLYPRILRRYRHRMKHKKGRAHVKAVQARALANAELFLLI

SEQ ID NO: 4476 - protein, 36 aa, Artificial Sequence
  Computer-generated peptide variant
RFKFWKKLYKLYKKQRLMFWKKLYLSTLASCKAQLQ

SEQ ID NO: 4477 - protein, 61 aa, Artificial Sequence
  Computer-generated peptide variant
KFRFIKKLMRKFRHLTLHKAGKRATGKAIGKRYCARSLRRLGAFLQQLKLNRVTKQCRWCA

SEQ ID NO: 4478 - protein, 52 aa, Artificial Sequence
  Computer-generated peptide variant
KYRMLCKYMRRIPKALNRARRLMNLDHQNAQNRAKKLMDCKGKLHKASLRQK

SEQ ID NO: 4479 - protein, 25 aa, Artificial Sequence
  Computer-generated peptide variant
WIKILKRLLKFFRRWKAMCTIAIAK

SEQ ID NO: 4480 - protein, 73 aa, Artificial Sequence
  Computer-generated peptide variant
LWRLFSRFLRLYHSNKALIKACELLKGKRNARYDSKLWWLKNSAVLKRKIPLECKKLAYLAHSKLKHLLPSQL

SEQ ID NO: 4481 - protein, 44 aa, Artificial Sequence
  Computer-generated peptide variant
RFRLIPRLIKKMQRTYMKSMRLAKYDAPLNLAKLAAKRKEILFY

SEQ ID NO: 4482 - protein, 92 aa, Artificial Sequence
  Computer-generated peptide variant
KIRLLHRFWKKFKRLIKKNNEGLAKLMACTLLCLAAKKRLKAWKRKSGRCRARNVALMKEFMALWRACDTKDVYSRKSKLENVSRLVKHARR

SEQ ID NO: 4483 - protein, 25 aa, Artificial Sequence
  Computer-generated peptide variant
KMKMIRRFLRKLRKAALELATLEAV

SEQ ID NO: 4484 - protein, 41 aa, Artificial Sequence
  Computer-generated peptide variant
KMRLLRKFIKFFKHARTAAGWAQSKLYSAATPYKKRASCAR

SEQ ID NO: 4485 - protein, 30 aa, Artificial Sequence
  Computer-generated peptide variant
RIKLLKRLWRYFRRHAESAAPKKNQFRDCA

SEQ ID NO: 4486 - protein, 64 aa, Artificial Sequence
  Computer-generated peptide variant
LIRYLKKLFRLMKKTYRKAVGWINAAAYRRDQQKALKLDTDAVCGLGSKAQRAIKRTRMRKLPK

SEQ ID NO: 4487 - protein, 35 aa, Artificial Sequence
  Computer-generated peptide variant
RFKLYTKMLRLLHQKKRRRHSQYLQRHRAAAALIT

SEQ ID NO: 4488 - protein, 53 aa, Artificial Sequence
  Computer-generated peptide variant
KWKFWKRYFRYLKRKLELCIVCYVALKAPLDMRRLRLLMRLRGRHFLSRMAIK

SEQ ID NO: 4489 - protein, 61 aa, Artificial Sequence
  Computer-generated peptide variant
RMKLYRRLYKRYCKKLRRARALAKLLRGMSGKAKAWMGDWRWTKRATAVRKYIFSEMAPFN

SEQ ID NO: 4490 - protein, 40 aa, Artificial Sequence
  Computer-generated peptide variant
YFKLMKKFIRLLRSRLTPCKKPYLLAAAGKRKLCAALPRR

SEQ ID NO: 4491 - protein, 22 aa, Artificial Sequence
  Computer-generated peptide variant
FLKLMRKMLRKFPNLRDKLVQA

SEQ ID NO: 4492 - protein, 32 aa, Artificial Sequence
  Computer-generated peptide variant
YLRILRRLLKFFQKQGRARPRLVLLKYNRIAT

SEQ ID NO: 4493 - protein, 24 aa, Artificial Sequence
  Computer-generated peptide variant
LWKWLKKMLKKFSNDFALKKKAGH

SEQ ID NO: 4494 - protein, 79 aa, Artificial Sequence
  Computer-generated peptide variant
LLRLLQRFYKRMKQLRLKLRALKPDNAKTLAEETKWIWDALRRASALRWFKTGLLYGFKAAGTKLFKFKNLPLDMARVA

SEQ ID NO: 4495 - protein, 37 aa, Artificial Sequence
  Computer-generated peptide variant
LLKILTRWLKKLCCAMAAASARTKWPMVIQRNAFRKK

SEQ ID NO: 4496 - protein, 29 aa, Artificial Sequence
  Computer-generated peptide variant
LIRWLNKFLKIWKRSAAAKGAGDKAYQAC

SEQ ID NO: 4497 - protein, 40 aa, Artificial Sequence
  Computer-generated peptide variant
MLRWMHKLLKRLKKWIMAGKRHRELHAKAYLRLYWIKQRR

SEQ ID NO: 4498 - protein, 85 aa, Artificial Sequence
  Computer-generated peptide variant
MLRIIRRLLRFLSKRIYLNQAHWAKHKAVTHDKACLYMEKAKMKLPLERMWLRLQRAAASKLKRDMNRAKACALRRRWLRRSSMW

SEQ ID NO: 4499 - protein, 21 aa, Artificial Sequence
  Computer-generated peptide variant
KMRWLRRFYKLYNKALATDLM

SEQ ID NO: 4500 - protein, 45 aa, Artificial Sequence
  Computer-generated peptide variant
LFRLLRKILRMLRCWKAKATVRLLDHLTQQRGLRKSTVSFLGREL

SEQ ID NO: 4501 - protein, 30 aa, Artificial Sequence
  Computer-generated peptide variant
KFKLLRKMWKLLNKRRRAHRIAGARQNNAG

SEQ ID NO: 4502 - protein, 36 aa, Artificial Sequence
  Computer-generated peptide variant
RFRWWKKLFKRMSTAPRLFQSKKALALALQKKRKAY

SEQ ID NO: 4503 - protein, 56 aa, Artificial Sequence
  Computer-generated peptide variant
KIRLWRRMFKLLQSGFRALNKFAAKAAHLLQLPRPKRVMRHEVKTLKYAKRALKPE

SEQ ID NO: 4504 - protein, 23 aa, Artificial Sequence
  Computer-generated peptide variant
KLKLFRRWWKRLSSLAHQRDEFA

SEQ ID NO: 4505 - protein, 43 aa, Artificial Sequence
  Computer-generated peptide variant
IIRMLRRLFKMWRCPNAALHEHTRTLCACRRVALARRWARLLR

SEQ ID NO: 4506 - protein, 39 aa, Artificial Sequence
  Computer-generated peptide variant
YLRFLQKFYRRWTTRGAGKKVIKAALKAYRRLARKCAVS

SEQ ID NO: 4507 - protein, 30 aa, Artificial Sequence
  Computer-generated peptide variant
FLKWLKKLMRYLKKKIKHKARNGLADKAYH

SEQ ID NO: 4508 - protein, 20 aa, Artificial Sequence
  Computer-generated peptide variant
RLRLMNKLFKKLHSDWEFLK

SEQ ID NO: 4509 - protein, 47 aa, Artificial Sequence
  Computer-generated peptide variant
KMRFLKRYYRLLKRRSRNNKLALALHFPDDIYNSLAHRTALFHAAAH

SEQ ID NO: 4510 - protein, 33 aa, Artificial Sequence
  Computer-generated peptide variant
RWRLYPKFLKMLTKLLKMLKALFLRLHPIPQWR

SEQ ID NO: 4511 - protein, 22 aa, Artificial Sequence
  Computer-generated peptide variant
RLRFFTRLWRKLPHLQLARWLK

SEQ ID NO: 4512 - protein, 52 aa, Artificial Sequence
  Computer-generated peptide variant
KLRFFNRFFKRLPRLIKWAAHRLMIKLKKLGQKPARTIHCKKWAMGLAAKQP

SEQ ID NO: 4513 - protein, 24 aa, Artificial Sequence
  Computer-generated peptide variant
LIRLFKRLMRRLRNLLFLKNSTQE

SEQ ID NO: 4514 - protein, 60 aa, Artificial Sequence
  Computer-generated peptide variant
KLRLLHKFFKRFSKCANKPLARYKFQRLRHSLKALRNQVLCLCHAVAMAKQTKAAKAEKK

SEQ ID NO: 4515 - protein, 28 aa, Artificial Sequence
  Computer-generated peptide variant
LLRYICKYLKLIRSNAKKRAKKAPTMAR

SEQ ID NO: 4516 - protein, 54 aa, Artificial Sequence
  Computer-generated peptide variant
FLRYLRKYFKLFKRAGRHRMLQLALSLEPLRIIRDAKQAAQKKPPALGYTSKAL

SEQ ID NO: 4517 - protein, 47 aa, Artificial Sequence
  Computer-generated peptide variant
RIKLLRRFFRFLRKAHCAFSMTLRAAKQRCKWAMLKFRGILLFGVRL

SEQ ID NO: 4518 - protein, 36 aa, Artificial Sequence
  Computer-generated peptide variant
KLRLMRRLLKLLTRFRIFRPPLAAKCKSQGLKMFMP

SEQ ID NO: 4519 - protein, 32 aa, Artificial Sequence
  Computer-generated peptide variant
RLKLYRRLYRLFRPGGFARAAATAQDVRTPAP

SEQ ID NO: 4520 - protein, 29 aa, Artificial Sequence
  Computer-generated peptide variant
FMRWWTRLLKKIRNEAAAKGARMHIWAAL

SEQ ID NO: 4521 - protein, 46 aa, Artificial Sequence
  Computer-generated peptide variant
LWKLLNRWLKRLTQEGLKAPFWRLALKVKSWEAQLALRPRRDKAKK

SEQ ID NO: 4522 - protein, 40 aa, Artificial Sequence
  Computer-generated peptide variant
KYRLYRKFFRLLRQRALNQETSPALYEKLLDRKRAKKYRP

SEQ ID NO: 4523 - protein, 24 aa, Artificial Sequence
  Computer-generated peptide variant
LFKYYNKLWKRMRKIARLGGLRLT

SEQ ID NO: 4524 - protein, 36 aa, Artificial Sequence
  Computer-generated peptide variant
KLRLLRRILRKFNKRRARLHHSKDLWLLVCQEYREI

SEQ ID NO: 4525 - protein, 23 aa, Artificial Sequence
  Computer-generated peptide variant
FFRLMKKFLKKYRRALNYAQMAA

SEQ ID NO: 4526 - protein, 60 aa, Artificial Sequence
  Computer-generated peptide variant
KLKIFPKFIRMWKPKCACEKLALKKCYKVNRWAARICKLPMLEKRLARKLLERRRVVNLD

SEQ ID NO: 4527 - protein, 57 aa, Artificial Sequence
  Computer-generated peptide variant
YYRLWTRMLRLLRSAIFKAKFAWRWAAETIFRRCISRKCRKVLLLAAKDSKYARAIR

SEQ ID NO: 4528 - protein, 44 aa, Artificial Sequence
  Computer-generated peptide variant
LWRFYHKLIRLLRRSAYRALRKLRSWYQARAQRRRWSIARNIAY

SEQ ID NO: 4529 - protein, 78 aa, Artificial Sequence
  Computer-generated peptide variant
LMKLLRRLWRFMNNLLAFTAKKLAIEYWRMQPCSFQLECFLEMAENPKLRRDRLYRLKLADARLRRRKKRNKRLLAAH

SEQ ID NO: 4530 - protein, 48 aa, Artificial Sequence
  Computer-generated peptide variant
RLKMLKKMLKKLTRRMQAIAKAAKLLLCHRELEAASKPKHPFAYAEAT

SEQ ID NO: 4531 - protein, 52 aa, Artificial Sequence
  Computer-generated peptide variant
LFRLISKLWRKMCKACAPEFLKKKPLRHWSLAYWLRLKKERSSATRLMAKYV

SEQ ID NO: 4532 - protein, 22 aa, Artificial Sequence
  Computer-generated peptide variant
MLKLLRRYWKKFCREARLAFAM

SEQ ID NO: 4533 - protein, 33 aa, Artificial Sequence
  Computer-generated peptide variant
LYRLFCRLMRLFRPFDELKKRELPTKLYRCRAR

SEQ ID NO: 4534 - protein, 80 aa, Artificial Sequence
  Computer-generated peptide variant
FYRLIKKMWKLFRKGTKAMAVLMYYYRLTSLLAAARHKGVLWLKSKLQKNIHKRTKTKCIAAAKVRQAAMMNAADKLRIL

SEQ ID NO: 4535 - protein, 24 aa, Artificial Sequence
  Computer-generated peptide variant
LMRLLKRLWRLIRCPAMRRKDANY

SEQ ID NO: 4536 - protein, 55 aa, Artificial Sequence
  Computer-generated peptide variant
RLRLWRRFLKFLKHDDRIIAAKRRLLLKLKLRLWSVHHKPLPRRDILREHMVAPP

SEQ ID NO: 4537 - protein, 55 aa, Artificial Sequence
  Computer-generated peptide variant
LFRLLKKIMKLLRNAWSKSILYAVLTIMRCKLTKGALIRLAKRCLKLRLIRKQKD

SEQ ID NO: 4538 - protein, 60 aa, Artificial Sequence
  Computer-generated peptide variant
YLKIIRKYIKRIHRQERVKLRHEKNMQLKARNADHFSLSKAQALDLATRSLKKKIWLRKL

SEQ ID NO: 4539 - protein, 57 aa, Artificial Sequence
  Computer-generated peptide variant
KLRMLSKLFRKFCRCILWALLRKYARGKYSLKYLNVSLKETRRPKETLDLRQACYKL

SEQ ID NO: 4540 - protein, 42 aa, Artificial Sequence
  Computer-generated peptide variant
WIKILNRIFRRLRKRNFQFLRLDELLAQLKKATYKGSLAAAG

SEQ ID NO: 4541 - protein, 30 aa, Artificial Sequence
  Computer-generated peptide variant
RYRILHKFFKFLKKKRNAGLGRLDKPAAFG

SEQ ID NO: 4542 - protein, 26 aa, Artificial Sequence
  Computer-generated peptide variant
KFKLFKKWLRLLQNARMNKWRVALKW

SEQ ID NO: 4543 - protein, 52 aa, Artificial Sequence
  Computer-generated peptide variant
KFRFFKRLWRKLKSKLKKRAAAWRQTVFMELAKRPEAAARFSGMARARLAGA

SEQ ID NO: 4544 - protein, 50 aa, Artificial Sequence
  Computer-generated peptide variant
KFRIFHKLLRKWCKLLKARWQSRRTAVLLWLPYDKTCLYLKARHALFYHA

SEQ ID NO: 4545 - protein, 92 aa, Artificial Sequence
  Computer-generated peptide variant
LLRLFRKLWRKLKRNHYRIKLGDKKTACRWLCRRTAAFLNRINLVLLRRQRKLKARARLAPRDISCVDAGCRIMKAAMIKCMGAGRAIDLVG

SEQ ID NO: 4546 - protein, 48 aa, Artificial Sequence
  Computer-generated peptide variant
FMRLIRKFLRKLQCKAEKLAALHWFKKRIKKAADRLAENKSDAWVGLQ

SEQ ID NO: 4547 - protein, 41 aa, Artificial Sequence
  Computer-generated peptide variant
KMRIMKRLLKFLKKRQPLLRRKAFLTHAHPHARDKLKCPLK

SEQ ID NO: 4548 - protein, 51 aa, Artificial Sequence
  Computer-generated peptide variant
RWKLYRRFLKRLNRYRAYWRAVMSQRATFRRLRYLAKEMARMFQKLLIMLR

SEQ ID NO: 4549 - protein, 24 aa, Artificial Sequence
  Computer-generated peptide variant
WWRFIKKFLKKLNRLLRAKSWMAA

SEQ ID NO: 4550 - protein, 42 aa, Artificial Sequence
  Computer-generated peptide variant
KMRIMKRFFKRIRKLMGAGLQKFLRARLLLDLLRKAFYAQLL

SEQ ID NO: 4551 - protein, 24 aa, Artificial Sequence
  Computer-generated peptide variant
RMKIFRKLLKKFNRAPLKAELCSA

SEQ ID NO: 4552 - protein, 48 aa, Artificial Sequence
  Computer-generated peptide variant
RLKLYRRFLKRLRSKRWANLARADLFKKVHWHQKRAAQQPYKKLMSMD

SEQ ID NO: 4553 - protein, 23 aa, Artificial Sequence
  Computer-generated peptide variant
RYKLLRKLLRKYKKIKLMPNQLA

SEQ ID NO: 4554 - protein, 60 aa, Artificial Sequence
  Computer-generated peptide variant
KMRFWKKMLKMLRKLGAPRNQLDAARLRRTIKARTKIAAPSLHQAPGRLLAAFALFHADL

SEQ ID NO: 4555 - protein, 63 aa, Artificial Sequence
  Computer-generated peptide variant
KMRWWHKMFRLLSKRAAKKIILLDRHKKRLKLWLPILMKYEILATAQAPRAGAGANVALYSKV

SEQ ID NO: 4556 - protein, 32 aa, Artificial Sequence
  Computer-generated peptide variant
LMKYFRKWWKRFKRFHLRAAKVEPLTAHALTK

SEQ ID NO: 4557 - protein, 29 aa, Artificial Sequence
  Computer-generated peptide variant
LLKYMKKFFKRLKKAHAKMAWDLACAAVK

SEQ ID NO: 4558 - protein, 39 aa, Artificial Sequence
  Computer-generated peptide variant
FMRILKKIMKLFRTLFAQWAKSKRYKAARARAVLYASVW

SEQ ID NO: 4559 - protein, 30 aa, Artificial Sequence
  Computer-generated peptide variant
LLRLIRRLYKRMKNPQAKVLYNASAILKAK

SEQ ID NO: 4560 - protein, 24 aa, Artificial Sequence
  Computer-generated peptide variant
WLRYWSRLLRYFQKLCKKRMLSRA

SEQ ID NO: 4561 - protein, 27 aa, Artificial Sequence
  Computer-generated peptide variant
KLKIWRRMFRKLQRALILLIWKCAPAR

SEQ ID NO: 4562 - protein, 78 aa, Artificial Sequence
  Computer-generated peptide variant
LWRMLKRLLKRIKSAHLPRLNKLNFRFGWTMKKKNKYALAQYKAIKLVLKLAFQQMAMDAQKRAHMNQLAVMLWYARA

SEQ ID NO: 4563 - protein, 43 aa, Artificial Sequence
  Computer-generated peptide variant
RYKLWPKWWKKLRRAAILWPLALPNKLKKAFYAKYRLMREDLL

SEQ ID NO: 4564 - protein, 32 aa, Artificial Sequence
  Computer-generated peptide variant
MMRLICRLLKRFTRAAKALRAEQKDKITISEL

SEQ ID NO: 4565 - protein, 73 aa, Artificial Sequence
  Computer-generated peptide variant
LLRLFRKFMRLMKRLDRARMKLLTMAFAKKDWHMLRNKRAMHKRDARLKMWKALKLAHAMDRLLYRQKNQRYD

SEQ ID NO: 4566 - protein, 79 aa, Artificial Sequence
  Computer-generated peptide variant
RLKILNKLLKKYRKCYGVAKSYAVLASQHLMSCPQAMRWLRCDWIPPKRALSRLIKVAYARKAIFLKARLVDAATKRLL

SEQ ID NO: 4567 - protein, 31 aa, Artificial Sequence
  Computer-generated peptide variant
LLRMLKKYLRMYKKVLLRKDHWCGLLNHKFK

SEQ ID NO: 4568 - protein, 28 aa, Artificial Sequence
  Computer-generated peptide variant
MMRLIRKLLKRLNRGPCYFWAAAQLAQK

SEQ ID NO: 4569 - protein, 42 aa, Artificial Sequence
  Computer-generated peptide variant
RWKLLRKLWKKMRQCLSVRLRHARKELHHCKALLKIMPLALR

SEQ ID NO: 4570 - protein, 34 aa, Artificial Sequence
  Computer-generated peptide variant
KLRFFKRLLKKLHRRWAERCFRGKRKNLAAAIIL

SEQ ID NO: 4571 - protein, 25 aa, Artificial Sequence
  Computer-generated peptide variant
LFRIFKKFFKLLSRLFCKKFALRRA

SEQ ID NO: 4572 - protein, 54 aa, Artificial Sequence
  Computer-generated peptide variant
RFKYICRLFRKLCRIENYLKKRPAHLKLYFLNKRELRQEACALLLGRDKPHKAP

SEQ ID NO: 4573 - protein, 98 aa, Artificial Sequence
  Computer-generated peptide variant
YLRLLKRLLKYIKRRRRWRRADLFRPATKLRLKQIQAMKNLLSAAKYEYYKKILLFLASKGAQTWEKNLNAIDGALSKRDMRYFFLLIGQKYAWQKRL

SEQ ID NO: 4574 - protein, 48 aa, Artificial Sequence
  Computer-generated peptide variant
LWKLMTRFIKLFRSLDFAFALRQALLRLARKPQYKTVRKKEREFARWD

SEQ ID NO: 4575 - protein, 99 aa, Artificial Sequence
  Computer-generated peptide variant
LMKLFRRILRLWKRDAMENIHRRYERLKKWKHKKKRKAKLISNRKYLRLFLVLVKVIAMWNMRREVRALKKKYCMLEASASLPAIKLKTTARCGMPLVK

SEQ ID NO: 4576 - protein, 58 aa, Artificial Sequence
  Computer-generated peptide variant
WLKIYPKFLRKFKPSARARVAKLFNKRLLEMIRHKEKLQLPRALKRRKFPISLDLFYR

SEQ ID NO: 4577 - protein, 79 aa, Artificial Sequence
  Computer-generated peptide variant
KLRLLKRMLKRLKRLLGFPKDNAAAERKVFVCSDKRHARSLRMKRAAKKMHNKLEGAAHDTDCKCKLRWPGDFPKFKKL

SEQ ID NO: 4578 - protein, 49 aa, Artificial Sequence
  Computer-generated peptide variant
RFRLMSKLFKRLCKSRLKLWKAGADMKKLLIGAVAFARLRKRAKQLLAA

SEQ ID NO: 4579 - protein, 49 aa, Artificial Sequence
  Computer-generated peptide variant
KLRLWQRYFKRLQQLVVARLRLRKRMLIVLAPACARAHKASACMAMHPI

SEQ ID NO: 4580 - protein, 51 aa, Artificial Sequence
  Computer-generated peptide variant
RFKYLKRMLRLFCRLNALGKCKAFNLFKRAYAVAAKRWKMGPANALHGMQA

SEQ ID NO: 4581 - protein, 37 aa, Artificial Sequence
  Computer-generated peptide variant
RLKWYHRMIRRICKYATADLELLAKAADAIMVPKARA

SEQ ID NO: 4582 - protein, 61 aa, Artificial Sequence
  Computer-generated peptide variant
RFKWWKRWFKRLRHKLLKADAVCHPHAAYKVARLLACSLRRLAVDVKAFATVIVSKLAHKE

SEQ ID NO: 4583 - protein, 69 aa, Artificial Sequence
  Computer-generated peptide variant
KLRLWKKMLKYFRPSLHAWRAFLKTRRRPSASRRLLCRAGRACPLLIKSARLKCLCEKAARAQTARRHN

SEQ ID NO: 4584 - protein, 46 aa, Artificial Sequence
  Computer-generated peptide variant
KWKLFRRLMRKMHKWFAQRGRQAVARGLRMRKAAAIKPALLLMHCW

SEQ ID NO: 4585 - protein, 33 aa, Artificial Sequence
  Computer-generated peptide variant
RYRWYQKIIKRFKKKLSALAILAKKAEVFKLHL

SEQ ID NO: 4586 - protein, 83 aa, Artificial Sequence
  Computer-generated peptide variant
WLKIIKKYLRFMQCPAADLATARRRPKPNLARLIACLYINKYRARRFTKKSVAAHLNKNRHKGGAMKKEKARKVLLKQGKWGK

SEQ ID NO: 4587 - protein, 57 aa, Artificial Sequence
  Computer-generated peptide variant
KFKMIQRLWKLLRNLQKTMRLLAVKYGKRPLMMASAEALFSLLDKDVRRRCAKYRHR

SEQ ID NO: 4588 - protein, 78 aa, Artificial Sequence
  Computer-generated peptide variant
KIRLMKKYFKKMHTQLGVIETKTAHGATDKKYLKKLMKGRKHPARRRCKAILYLLRPHLLLGLRLLRTMALKLRRLFG

SEQ ID NO: 4589 - protein, 22 aa, Artificial Sequence
  Computer-generated peptide variant
WYRLICRYFKFLKRSQAAKLAR

SEQ ID NO: 4590 - protein, 20 aa, Artificial Sequence
  Computer-generated peptide variant
FFKWLTKLIKKIKRKQAWLL

SEQ ID NO: 4591 - protein, 25 aa, Artificial Sequence
  Computer-generated peptide variant
RLKLLCKFWRKFKKALVFGHAWLLR

SEQ ID NO: 4592 - protein, 55 aa, Artificial Sequence
  Computer-generated peptide variant
KIRWMSRWFKFLKRLQKARHSKLCAKARRKLINTRRLLHLKRAHYLLRKLVYRLQ

SEQ ID NO: 4593 - protein, 97 aa, Artificial Sequence
  Computer-generated peptide variant
KMKYMPKYMKRLSRGGEITAAAATQRLYTAVWKGKIALRCRAYKENLVMFRKLDPALHLKAPAARRRFRRGSKRAPLKANDLANKGQALAPLLLARE

SEQ ID NO: 4594 - protein, 53 aa, Artificial Sequence
  Computer-generated peptide variant
KIKLLNRFLKKLRKLLKNVNDELSAIILAANEWICFLKASSKYKALATKLTRL

SEQ ID NO: 4595 - protein, 32 aa, Artificial Sequence
  Computer-generated peptide variant
RLRWFKKFLKFWTCRYKRALLPWAAFQLKRTM

SEQ ID NO: 4596 - protein, 81 aa, Artificial Sequence
  Computer-generated peptide variant
KLKLYKKWYRRFPRNNTKYQRAEIKQAARVWALKLKQAGSMAPAESRELKWALRNTEARARHWAYAYRLHMAALKERAKAA

SEQ ID NO: 4597 - protein, 32 aa, Artificial Sequence
  Computer-generated peptide variant
LLKYYTKFLKKLPKELCRARWCELAFAAFSRG

SEQ ID NO: 4598 - protein, 67 aa, Artificial Sequence
  Computer-generated peptide variant
LFKFLRKLFRKLHRHMSCAGCLAIGLRRQAVWRKKIRDPALKLRTRQVYPYRELHLAASAKRGRKMA

SEQ ID NO: 4599 - protein, 54 aa, Artificial Sequence
  Computer-generated peptide variant
MMRFLRRLLRRYKTGNQQRVLDKKVKLALSILLRLWYDATTEWLAFRKKAARLC

SEQ ID NO: 4600 - protein, 84 aa, Artificial Sequence
  Computer-generated peptide variant
RFRMINRWFKKFRRAKAVKGKALLKYKLKLDLARTQVKALAAGKAAQLWRRLKLKWPFEDKDGASVETQRNWKCQALLAQGRKE

SEQ ID NO: 4601 - protein, 97 aa, Artificial Sequence
  Computer-generated peptide variant
KWKMFRRLLKRFKRKDTLERPRMNHAKKKLRACGRNVKMMAKRIWIDARALLKASITLRAKDLMQARDKRAHVCYLMFKPACRKLSAAKWQSKKRAA

SEQ ID NO: 4602 - protein, 26 aa, Artificial Sequence
  Computer-generated peptide variant
RFRILSKIYRKLKHWRARVQILLAFL

SEQ ID NO: 4603 - protein, 30 aa, Artificial Sequence
  Computer-generated peptide variant
LLRWYKRLFKFMPRAKKAATGRQLKRGLDI

SEQ ID NO: 4604 - protein, 67 aa, Artificial Sequence
  Computer-generated peptide variant
RFKFLKRFYKKWRKRAVGKWCLYDRLKAYAGEGKAYIKVARDASEWLLRAAARLQNLCLLAAFNAHR

SEQ ID NO: 4605 - protein, 44 aa, Artificial Sequence
  Computer-generated peptide variant
RIKLMKRLFRKMRNRLRMLYAKLPAPYAPKRDCMNKRRWSDLLA

SEQ ID NO: 4606 - protein, 23 aa, Artificial Sequence
  Computer-generated peptide variant
YLKLYNKLLKLMPRRKLAYKCQQ

SEQ ID NO: 4607 - protein, 20 aa, Artificial Sequence
  Computer-generated peptide variant
LFRFLRRILKKLKCHYLFTQ

SEQ ID NO: 4608 - protein, 39 aa, Artificial Sequence
  Computer-generated peptide variant
WLRLYPRLFRYMRKLKVNLALKVQLSRLRTKKAKCREAK

SEQ ID NO: 4609 - protein, 38 aa, Artificial Sequence
  Computer-generated peptide variant
KWRLLKRYLKYLKCLLLLTSEYQCWKMLPKRALFCRYQ

SEQ ID NO: 4610 - protein, 81 aa, Artificial Sequence
  Computer-generated peptide variant
RLRWMHKLLKRWKTCAALNTARLRFYHLKVAASLRKLRRRPKIEEGRCPHALLDARKRDGEKAACQLKKLKKTMNVQHAFP

SEQ ID NO: 4611 - protein, 56 aa, Artificial Sequence
  Computer-generated peptide variant
RYRLYKRIFRKIKSLQLMAKCKERRLAPLPNYMRIFLRPARGLLLRFALKALRLPE

SEQ ID NO: 4612 - protein, 40 aa, Artificial Sequence
  Computer-generated peptide variant
MWRYMTKYFRRLSSRRHKGQRAKRDNLGLEKYLLKAHKLL

SEQ ID NO: 4613 - protein, 50 aa, Artificial Sequence
  Computer-generated peptide variant
FLKMFKKILKKLCKLQYRLAPTDSEHRKAARPIGLKIYKGELAWLAAKKF

SEQ ID NO: 4614 - protein, 26 aa, Artificial Sequence
  Computer-generated peptide variant
RLKLLRKFLRYFSRLSPAALRSTSLH

SEQ ID NO: 4615 - protein, 38 aa, Artificial Sequence
  Computer-generated peptide variant
FFRLMKRMFKRFNKLEAWKPNAKKFWRACLAMLKLLNY

SEQ ID NO: 4616 - protein, 45 aa, Artificial Sequence
  Computer-generated peptide variant
RMKILKKLFKKLTHARKLLLKREYVLLLWQRTLPRKYAQYMLFAE

SEQ ID NO: 4617 - protein, 24 aa, Artificial Sequence
  Computer-generated peptide variant
FLRFIKKWLRRLPKLLAWDRKPGE

SEQ ID NO: 4618 - protein, 59 aa, Artificial Sequence
  Computer-generated peptide variant
KYKWWTRWIRKLKNYKMARTQAITFYLCYLVRKAWTALALKLVKAKLCLARTRHERKAV

SEQ ID NO: 4619 - protein, 25 aa, Artificial Sequence
  Computer-generated peptide variant
FLRFLRRLFKMMNRRAQYLLAWCLR

SEQ ID NO: 4620 - protein, 95 aa, Artificial Sequence
  Computer-generated peptide variant
KYRLLTRIMKRIKRWRRLQATKCLGLKHKRRHRQAKLKAIWVIPYAQRPDEIRTTCLAARLAFIAKKKLRSANARCRLRAEHLKGSKAHRHVNRF

SEQ ID NO: 4621 - protein, 29 aa, Artificial Sequence
  Computer-generated peptide variant
MYKILQKWIKFIRRQVRLAELVLKRRLLG

SEQ ID NO: 4622 - protein, 34 aa, Artificial Sequence
  Computer-generated peptide variant
KLKWLPKLMKRMRKLSHQQYAASAHRKFLLLRKF

SEQ ID NO: 4623 - protein, 75 aa, Artificial Sequence
  Computer-generated peptide variant
FFKFFKRLLKKWHKVRRAFVDALLFLSIMYLRDENKRKLRKMKMKARADAFGKKRLEARLLNKSEARLRGASGFL

SEQ ID NO: 4624 - protein, 25 aa, Artificial Sequence
  Computer-generated peptide variant
MIKWIKKLIKRLKSCLARVLRSRAA

SEQ ID NO: 4625 - protein, 63 aa, Artificial Sequence
  Computer-generated peptide variant
RWKLWRRMFRFWTRRPTKMALCARAGKCLFRFLILPHALRNRQRHLVVLAAQYVTAKRLQALK

SEQ ID NO: 4626 - protein, 41 aa, Artificial Sequence
  Computer-generated peptide variant
WLKYFHRYFKKLKKAELYASRMCSAARAKKSAAACKRRKMR

SEQ ID NO: 4627 - protein, 84 aa, Artificial Sequence
  Computer-generated peptide variant
KYRFIRRLLRRLNNLGDKLAQGKHWKRKLKKALVTTVCCDFQLRVTALRLSRACARRAKAIAATVKSKLRVTKESHRDRKKCLL

SEQ ID NO: 4628 - protein, 37 aa, Artificial Sequence
  Computer-generated peptide variant
YLKLFSKLIKILKTAKGKIKKRFPAAVRVKLHPPALR

SEQ ID NO: 4629 - protein, 29 aa, Artificial Sequence
  Computer-generated peptide variant
IMKLMQRLMRKYRRMNLWALRRCAKIMLF

SEQ ID NO: 4630 - protein, 44 aa, Artificial Sequence
  Computer-generated peptide variant
RLKMIKRYYKRFRQAKRHSARKLRLFLIWWLARSANPAAALPCD

SEQ ID NO: 4631 - protein, 82 aa, Artificial Sequence
  Computer-generated peptide variant
LFKFYTRLLRLYQTDKRQPAFLHELKLIRMEARKYALRFPWRCWVRAKKHAKRLDRPALMRACDLAYLVLWGREKKKKERLK

SEQ ID NO: 4632 - protein, 24 aa, Artificial Sequence
  Computer-generated peptide variant
RLKLLCKWMRKLRKQAAAWLVGPE

SEQ ID NO: 4633 - protein, 33 aa, Artificial Sequence
  Computer-generated peptide variant
LMRLYKRLLRLMCKEDIKYKAAAARMNFLKEAR

SEQ ID NO: 4634 - protein, 55 aa, Artificial Sequence
  Computer-generated peptide variant
KLRFFKKIWRRIKKKKARLLAWAWGLAKANRCRSTHLRKNSQYWAARLKWRFPTA

SEQ ID NO: 4635 - protein, 41 aa, Artificial Sequence
  Computer-generated peptide variant
KWKMLKKFLKRLCTRIDKLAAPYHPRQRADRRDMLQLFCAL

SEQ ID NO: 4636 - protein, 23 aa, Artificial Sequence
  Computer-generated peptide variant
FLKLFRRLLKWFKRQAELSDWAL

SEQ ID NO: 4637 - protein, 34 aa, Artificial Sequence
  Computer-generated peptide variant
KYRLYRRLYRWYCTKLKMKHQLKGNVLLLLNREA

SEQ ID NO: 4638 - protein, 58 aa, Artificial Sequence
  Computer-generated peptide variant
RFRWFNRFLKYFTKDLAARLDQRAKCAKMRLKRQIKVNAIDTAALAVHRCQASLKKLL

SEQ ID NO: 4639 - protein, 31 aa, Artificial Sequence
  Computer-generated peptide variant
LLRMYKKMFRRIKCKLAAKLAEYRQGGFRAK

SEQ ID NO: 4640 - protein, 27 aa, Artificial Sequence
  Computer-generated peptide variant
KYRLWKKLWRLIPNQNAASRQTLLAPK

SEQ ID NO: 4641 - protein, 68 aa, Artificial Sequence
  Computer-generated peptide variant
LLKFLRKYLKLFKRMKLLKARWLFRDLAWYALLFHQPLIARAYKKKRRVAAQKMIWYSGIKIKSKQGS

SEQ ID NO: 4642 - protein, 73 aa, Artificial Sequence
  Computer-generated peptide variant
KLKMLKKIIRFYHRNPKRVLAHKRADPLLYDCAVAELDMASLTYAAARAKRLDWLMARWIRRAKAQCKGKGRL

SEQ ID NO: 4643 - protein, 38 aa, Artificial Sequence
  Computer-generated peptide variant
RWRILKKFLKWIKHPGAWKIGRLLRLRSLRTPLTQKAM

SEQ ID NO: 4644 - protein, 32 aa, Artificial Sequence
  Computer-generated peptide variant
KIRFMRRYLRLLSRLAKYKWFLATNMYDKPLR

SEQ ID NO: 4645 - protein, 47 aa, Artificial Sequence
  Computer-generated peptide variant
RLKLFNRILRRWSTSKKKKNERPCRWWLKLCNVRGLNEKLLAADPAL

SEQ ID NO: 4646 - protein, 28 aa, Artificial Sequence
  Computer-generated peptide variant
RFRIMPKLLRLLPTHEARPQLKWRLLWL

SEQ ID NO: 4647 - protein, 27 aa, Artificial Sequence
  Computer-generated peptide variant
FLRWFTRWIKRLRPRLTMWQAKLYLRA

SEQ ID NO: 4648 - protein, 87 aa, Artificial Sequence
  Computer-generated peptide variant
KLKLLPRLLKLLTHHVLVKRRVRRLEPPLRKKAMCMAHFKNAATLKLRFPALKEFLSLFHKRMRAACLAYADMLIACDYKCEWYRQA

SEQ ID NO: 4649 - protein, 36 aa, Artificial Sequence
  Computer-generated peptide variant
RIRIIRKLFKRLPPAAKRILAKDAYKWLTGLAYLDQ

SEQ ID NO: 4650 - protein, 42 aa, Artificial Sequence
  Computer-generated peptide variant
RYRFWKRYLKFFKKVVNFETKALYSKAGLRLDLLRLRKQQLR

SEQ ID NO: 4651 - protein, 22 aa, Artificial Sequence
  Computer-generated peptide variant
LLRYLRRFLRRFRRICANLTKC

SEQ ID NO: 4652 - protein, 53 aa, Artificial Sequence
  Computer-generated peptide variant
KLKMYPKFFKKWKRDAGKACEYRLVFLRHLLLKLQKREIRKTIALRLARGNFG

SEQ ID NO: 4653 - protein, 27 aa, Artificial Sequence
  Computer-generated peptide variant
KIRYLSKLLKRLPRDHFSFLLQSALKL

SEQ ID NO: 4654 - protein, 22 aa, Artificial Sequence
  Computer-generated peptide variant
RYRLFKKYYKLIRRACLATAKQ

SEQ ID NO: 4655 - protein, 60 aa, Artificial Sequence
  Computer-generated peptide variant
KFKWLCRYWRLLCRDAAAMRLGVSKYDLATRRKKQYLLQLKKKVWPARLMLLDIKGRYAG

SEQ ID NO: 4656 - protein, 30 aa, Artificial Sequence
  Computer-generated peptide variant
RWKIFNKFIRLYKRAVARLRLELLLRTTII

SEQ ID NO: 4657 - protein, 25 aa, Artificial Sequence
  Computer-generated peptide variant
KYKILCKIYRKLRKKAKILAMAARA

SEQ ID NO: 4658 - protein, 47 aa, Artificial Sequence
  Computer-generated peptide variant
RYRLLRKMLRKMRQCPRNAFSVPEACQRKATLMARLKKPLNAKPLCS

SEQ ID NO: 4659 - protein, 43 aa, Artificial Sequence
  Computer-generated peptide variant
FFRWIRKLLKMLRRCRAKAFDLRKCDAMAIILNCKGRILLNLI

SEQ ID NO: 4660 - protein, 33 aa, Artificial Sequence
  Computer-generated peptide variant
FLKYLRKYLKRYPHPKVVNLRWQLRTLLRLKSR

SEQ ID NO: 4661 - protein, 33 aa, Artificial Sequence
  Computer-generated peptide variant
KLRLITKLFKRLTNNKKLRLAAPRAAWIRCDMR

SEQ ID NO: 4662 - protein, 23 aa, Artificial Sequence
  Computer-generated peptide variant
MLRLLNRFMKFLSKKLAGSNKLS

SEQ ID NO: 4663 - protein, 27 aa, Artificial Sequence
  Computer-generated peptide variant
LWKLLPRMLRKFHHTAKKAKMDCLRAA

SEQ ID NO: 4664 - protein, 23 aa, Artificial Sequence
  Computer-generated peptide variant
IWKLLNKLLRKFNRPRLAARQVH

SEQ ID NO: 4665 - protein, 59 aa, Artificial Sequence
  Computer-generated peptide variant
KIRFIRKWIKFMRCRACADLCAVIAPVAQKKYKRLKAREWLRLPKYARLRLNNRDAECR

SEQ ID NO: 4666 - protein, 45 aa, Artificial Sequence
  Computer-generated peptide variant
RFRLYRKMLKKFQCFARVSDASGARLKNRNIKLQTRLKKAPLRFL

SEQ ID NO: 4667 - protein, 76 aa, Artificial Sequence
  Computer-generated peptide variant
FLKLLRRYLKRLRKDARPRGPNGGFRLLHIKKCRAAALWHWSGCSKRRKNVKLKAVMRKAVALRFCLHCYNFPARA

SEQ ID NO: 4668 - protein, 37 aa, Artificial Sequence
  Computer-generated peptide variant
RLRMLKKLWKWLRKEYKANLRSPAGLYKKKHVAEYAF

SEQ ID NO: 4669 - protein, 34 aa, Artificial Sequence
  Computer-generated peptide variant
MFRLLKRYLKFYNHKIAAHKRRLNKALNKKNRAN

SEQ ID NO: 4670 - protein, 31 aa, Artificial Sequence
  Computer-generated peptide variant
LMRFISKLLRWLRKKEEIRQNLRKLYRAAMA

SEQ ID NO: 4671 - protein, 28 aa, Artificial Sequence
  Computer-generated peptide variant
KLRWLRRWLRRLRQWRLLWAIKDEKGQA

SEQ ID NO: 4672 - protein, 75 aa, Artificial Sequence
  Computer-generated peptide variant
RLKILHRMMRWFRKPIKYTRRFLLARLDMNIANRRPRQLRAALKELKRLSLPRSCRKTGKATTCRQLTKAEKLRC

SEQ ID NO: 4673 - protein, 88 aa, Artificial Sequence
  Computer-generated peptide variant
RLRLFKKFFKKFCRRILAYSMRKLWTKCWRFFEANWIRKLKHAVYRAPRAEPLASIKRWNTYAWASKRCKTLKNAKAAKFERWKLAAK

SEQ ID NO: 4674 - protein, 20 aa, Artificial Sequence
  Computer-generated peptide variant
RFKWMKRYFRWLCRLPAEAL

SEQ ID NO: 4675 - protein, 22 aa, Artificial Sequence
  Computer-generated peptide variant
LLKFLRKILRRFKSLLNHRRYM

SEQ ID NO: 4676 - protein, 69 aa, Artificial Sequence
  Computer-generated peptide variant
RFKMWRRLWKKLKHLANAKKGRLGAKRKVALRWEKKRRGQDAYKIYALTCLAHTDINAWEGLHRIAKII

SEQ ID NO: 4677 - protein, 43 aa, Artificial Sequence
  Computer-generated peptide variant
YIKYLKRYWRKLKKLKQPLDMERRSCKHDHLLYLIHKRLLKQA

SEQ ID NO: 4678 - protein, 44 aa, Artificial Sequence
  Computer-generated peptide variant
KLKIMPKLIRLFRRKGAMKLQDWTDLLQYVKLKNYLCARAGALK

SEQ ID NO: 4679 - protein, 20 aa, Artificial Sequence
  Computer-generated peptide variant
LFRLWSKLWKWLSQRKLAFQ

SEQ ID NO: 4680 - protein, 80 aa, Artificial Sequence
  Computer-generated peptide variant
FWKIFHKLWKKLRKVREFARELRFLNDNYAKRNEAALPRPLNTPKNRFRHYTWRLAAKAKQMAFLLLVKRLSRLCARAAR

SEQ ID NO: 4681 - protein, 34 aa, Artificial Sequence
  Computer-generated peptide variant
IMRWLNRLYRLMRRLRRTDANIVTHGARRAKRAA

SEQ ID NO: 4682 - protein, 55 aa, Artificial Sequence
  Computer-generated peptide variant
RYRILQRFWRRLKKNRAASGDAIAAHMAGREQRLRMHVPFAYKLVLKALRLPKKR

SEQ ID NO: 4683 - protein, 23 aa, Artificial Sequence
  Computer-generated peptide variant
RFKIMTKLFRLLRKKLVASFFAH

SEQ ID NO: 4684 - protein, 26 aa, Artificial Sequence
  Computer-generated peptide variant
LMKLIRRLIRLFHCNMDLKAKKEALK

SEQ ID NO: 4685 - protein, 37 aa, Artificial Sequence
  Computer-generated peptide variant
FLRILRKFMKKWCTRNIKKCLKAYCGLRSLARAHLLI

SEQ ID NO: 4686 - protein, 41 aa, Artificial Sequence
  Computer-generated peptide variant
FFKMWKKFFRLFKRIALAKNGSRALAKLLRAYIRRSAAATV

SEQ ID NO: 4687 - protein, 33 aa, Artificial Sequence
  Computer-generated peptide variant
WLKLFNRLLRRFSKKARRALLCNAMAARKDRAG

SEQ ID NO: 4688 - protein, 47 aa, Artificial Sequence
  Computer-generated peptide variant
LMKLFRRFWRIIQRRRARLTKRSANASLTIKLYKAMQARWRWALNDI

SEQ ID NO: 4689 - protein, 54 aa, Artificial Sequence
  Computer-generated peptide variant
RLKWFCRFWKFWRRRVKNKLLPALAYRSLDKAKLKHAHKLLYNDKAKPLREKKE

SEQ ID NO: 4690 - protein, 30 aa, Artificial Sequence
  Computer-generated peptide variant
FFRYFRRYLKRFRHLKINERFLRALACANR

SEQ ID NO: 4691 - protein, 80 aa, Artificial Sequence
  Computer-generated peptide variant
FMKYLKKWWRLYTCKLHDKQKYKMARIVRYGPNKKLLRADTKYFKQRLKKKQARAAADHAKTPRELKIEMKLKLAMRLAV

SEQ ID NO: 4692 - protein, 34 aa, Artificial Sequence
  Computer-generated peptide variant
ILRIMRRILKRMTPACAEAKNAKAARLAQRATKW

SEQ ID NO: 4693 - protein, 30 aa, Artificial Sequence
  Computer-generated peptide variant
FFRLLRRLLKKFSKCALFWQWRRLKDLRAS

SEQ ID NO: 4694 - protein, 82 aa, Artificial Sequence
  Computer-generated peptide variant
RFKWFKRLIKFYKSQAWQKQRWKALLAHARKWAKDRLALLRHHLDAKMSTVGRLKDKLMLKMMLQLLRARWEHLEWLAALKR

SEQ ID NO: 4695 - protein, 32 aa, Artificial Sequence
  Computer-generated peptide variant
KWKLWRRFIKRLCRMAARNFNRAAAPQEFKKA

SEQ ID NO: 4696 - protein, 47 aa, Artificial Sequence
  Computer-generated peptide variant
LLRLYHKIYRMLNTLLAAKDVYLTKWAEWRFLLDAKHKKGANWSKAR

SEQ ID NO: 4697 - protein, 31 aa, Artificial Sequence
  Computer-generated peptide variant
WYKLLKRYLKKFRRARAEMSRKLAAMENNPL

SEQ ID NO: 4698 - protein, 64 aa, Artificial Sequence
  Computer-generated peptide variant
MYKFLHRFLKKLRHAGAYRLRGARLSSKLLPARKRAARYKVDTRAERWWVLDIQRHLLRFVLSP

SEQ ID NO: 4699 - protein, 48 aa, Artificial Sequence
  Computer-generated peptide variant
LFKLLRRLLRWWKRARRRPVFRRVLTLGDWYKLNLLCRDLWIRCAWAG

SEQ ID NO: 4700 - protein, 39 aa, Artificial Sequence
  Computer-generated peptide variant
RMRMLKRMLKLFQKARNLPSLTAANLVGMLARFCKYKKK

SEQ ID NO: 4701 - protein, 94 aa, Artificial Sequence
  Computer-generated peptide variant
YLRLLCKLLKRMKRPPYRRKLWRRACRWNAAAAELQSDALHLWLVYALKLRCLVERHCKKKAKLDRLPLWMDAAIDSAGSLRNPRKYRWLRFMA

SEQ ID NO: 4702 - protein, 32 aa, Artificial Sequence
  Computer-generated peptide variant
KFKIMRRLLKRWTQALPLLLWTDAKSRVANRR

SEQ ID NO: 4703 - protein, 57 aa, Artificial Sequence
  Computer-generated peptide variant
FIKLLSRILRMFKCLDKGRKKSLSLGKGQYHGKAGTLADKCKLKAELDLNKLELRLK

SEQ ID NO: 4704 - protein, 22 aa, Artificial Sequence
  Computer-generated peptide variant
LWKFWHKLFKRLQKKLAAGASE

SEQ ID NO: 4705 - protein, 56 aa, Artificial Sequence
  Computer-generated peptide variant
KLKWMPRFLKKIRRLDGNTALHTNEDVMKYKKRRHRELPVPFLKKKLLWLACRARA

SEQ ID NO: 4706 - protein, 53 aa, Artificial Sequence
  Computer-generated peptide variant
FLKYLKKLYKLLRRKAKEWLVKATLQAFRKRKFKPLPQNARNLRYSPQKKTML

SEQ ID NO: 4707 - protein, 63 aa, Artificial Sequence
  Computer-generated peptide variant
LLRYFRRLYRKIRTIILADRLYNLDKAARAFHDANRAFAKALLRALDYIKRKPGRERRKECLF

SEQ ID NO: 4708 - protein, 51 aa, Artificial Sequence
  Computer-generated peptide variant
KYKLIQKIWRKIRQLLGKRSAKKALRLPKTAWRQALRIDMLKENIYNKLGK

SEQ ID NO: 4709 - protein, 29 aa, Artificial Sequence
  Computer-generated peptide variant
RLRFMKKLLKRLTRLDINSCLYLAAYWRA

SEQ ID NO: 4710 - protein, 74 aa, Artificial Sequence
  Computer-generated peptide variant
KFRFLKKFIKKMKTKLISLWKLIAKGLTRPLSYKLAYIKAYAAQAKKKRFKEFRRVRLRLQGYQRKPLHAHFVP

SEQ ID NO: 4711 - protein, 30 aa, Artificial Sequence
  Computer-generated peptide variant
WYRYFQRYLRKLKQRVRLWRARELCSPKAL

SEQ ID NO: 4712 - protein, 26 aa, Artificial Sequence
  Computer-generated peptide variant
RFKWLRRYFKMFRQLKRLAAGLLHLI

SEQ ID NO: 4713 - protein, 63 aa, Artificial Sequence
  Computer-generated peptide variant
RFKLWKKLFKLLNQARAQTAITGAKAPRWCQLFDKELRVKLLLPQLAMFRRPNRCEGRIKKAL

SEQ ID NO: 4714 - protein, 38 aa, Artificial Sequence
  Computer-generated peptide variant
RWKFLCKIIRRYKPFAAAFPKQPAARLVCKYKLRWRDA

SEQ ID NO: 4715 - protein, 86 aa, Artificial Sequence
  Computer-generated peptide variant
LLKLLRKFWRWWRQFTARAYDARKLRHYKKLAAKRSLLKRDLKRYAQRASANPKHKAFDEALRMGQWTIKGPMTIKRKSILKGGAR

SEQ ID NO: 4716 - protein, 20 aa, Artificial Sequence
  Computer-generated peptide variant
KFKYLPKILKRLNNAANLLC

SEQ ID NO: 4717 - protein, 26 aa, Artificial Sequence
  Computer-generated peptide variant
KLKLLRRLLRLFRRFENAANLLRRWI

SEQ ID NO: 4718 - protein, 23 aa, Artificial Sequence
  Computer-generated peptide variant
RLRLFKRFLRRLQRLKLGNHCAA

SEQ ID NO: 4719 - protein, 41 aa, Artificial Sequence
  Computer-generated peptide variant
IYRFLHKLYRMLKKKACKKLCNRLKRLACALFQLAMSQISR

SEQ ID NO: 4720 - protein, 20 aa, Artificial Sequence
  Computer-generated peptide variant
RLRLYNRMLRKLRQCRMDAG

SEQ ID NO: 4721 - protein, 25 aa, Artificial Sequence
  Computer-generated peptide variant
MLKLYSRMLRMFRRHTLRRKLVNNA

SEQ ID NO: 4722 - protein, 73 aa, Artificial Sequence
  Computer-generated peptide variant
RWRLYRRFLKRFQPRLDLKRRSRKAKYEQLRLKKQVRQKKTALFFACRKYRRALYWLAASMLTKCLADCKWRL

SEQ ID NO: 4723 - protein, 66 aa, Artificial Sequence
  Computer-generated peptide variant
FLKWLKRMFRYLKRRRWYWFKLALFNMRLEFDRKAKRKYRFDCLALWKSALPYFLDILACKKLYRN

SEQ ID NO: 4724 - protein, 21 aa, Artificial Sequence
  Computer-generated peptide variant
FWRLLPRFLRKMKKTKIAHPL

SEQ ID NO: 4725 - protein, 37 aa, Artificial Sequence
  Computer-generated peptide variant
LFRYLRRILKKLRNHARLLAPMKLMRMPCLDPARASH

SEQ ID NO: 4726 - protein, 24 aa, Artificial Sequence
  Computer-generated peptide variant
KLRLFTRILKRYKSMLHKAKTCAA

SEQ ID NO: 4727 - protein, 80 aa, Artificial Sequence
  Computer-generated peptide variant
RMKLFPKLIRYFKKAGQFLRNMHARKCSLVLMVWALDLPARYRMRMAAVDRWAYQKLYWALKRKRAYKKGLGAKAAQKDT

SEQ ID NO: 4728 - protein, 63 aa, Artificial Sequence
  Computer-generated peptide variant
FYRLMCKLWKWMRNALCPRLRRLTLDARQEMRRALMHPRQLRVRKICKPLRLKLRFRALPQYM

SEQ ID NO: 4729 - protein, 34 aa, Artificial Sequence
  Computer-generated peptide variant
LMKIFKRLLRLLSKTRVKRIIAKFKIYCANKLNC

SEQ ID NO: 4730 - protein, 77 aa, Artificial Sequence
  Computer-generated peptide variant
RMRYWKRFYKYLKRRALYLAGKWKDKLPTTRRKILARRALTNARAASNLVTKYAHARLMKRLRNTLPHQLGKWMADD

SEQ ID NO: 4731 - protein, 39 aa, Artificial Sequence
  Computer-generated peptide variant
LLKLMRKLLRRLKRTKIARADPVTADLLLKCDRKLNVRK

SEQ ID NO: 4732 - protein, 69 aa, Artificial Sequence
  Computer-generated peptide variant
FYKLFRKLFRLYCKPAKALRLAADCMSSCVANYQRARARQQSDLRWFLERRRMKQKLPARKKDPRSSKL

SEQ ID NO: 4733 - protein, 27 aa, Artificial Sequence
  Computer-generated peptide variant
KLKLLKKMLRRLKKDAPVFRCLATICA

SEQ ID NO: 4734 - protein, 62 aa, Artificial Sequence
  Computer-generated peptide variant
LLRLWKKILRKYRRHSKNAMFIHLEQKKRDRAVAKKTLGYEWAKARASAVIRAKALLHKESC

SEQ ID NO: 4735 - protein, 34 aa, Artificial Sequence
  Computer-generated peptide variant
RFRFYQKLLKKFNKLAAILRLEIDETALATIARF

SEQ ID NO: 4736 - protein, 35 aa, Artificial Sequence
  Computer-generated peptide variant
FLRLWPKYIRRLRTKTARQNAAFISRLQLKASSAK

SEQ ID NO: 4737 - protein, 32 aa, Artificial Sequence
  Computer-generated peptide variant
LFRLIPRWWRKLKCKLLVKFDKAAERCALKCK

SEQ ID NO: 4738 - protein, 55 aa, Artificial Sequence
  Computer-generated peptide variant
RWRLFTRLLRRLTKNWFSRVIAWSLLCFRDVATLGAKRWYLKGKLLAKLSKATRW

SEQ ID NO: 4739 - protein, 35 aa, Artificial Sequence
  Computer-generated peptide variant
RMRWLKKLYKFLPKKAKIMKMAAAVWKWFLAYDKR

SEQ ID NO: 4740 - protein, 51 aa, Artificial Sequence
  Computer-generated peptide variant
LIKMLSKMIKLLSREWMKWRARRRKLPAYHRRLKFLAAKYAMQAHRMKSSN

SEQ ID NO: 4741 - protein, 34 aa, Artificial Sequence
  Computer-generated peptide variant
FLKMLPRLLKKMKCKWNPTKAEYAAIKASELAMA

SEQ ID NO: 4742 - protein, 32 aa, Artificial Sequence
  Computer-generated peptide variant
FYRWLKRLYKLYCKHSTRRLLAKAMAKDLLHV

SEQ ID NO: 4743 - protein, 30 aa, Artificial Sequence
  Computer-generated peptide variant
RWKLLKRFIKWIKQAAKGARPYATRALYMI

SEQ ID NO: 4744 - protein, 20 aa, Artificial Sequence
  Computer-generated peptide variant
LYRFFKRFMRRLKSLAKLNM

SEQ ID NO: 4745 - protein, 60 aa, Artificial Sequence
  Computer-generated peptide variant
RLKLLKRFWRRFSKDGIETDNWRKLAGRVALNIRAAAKWALQLQRRAFNLRQRKICKRQF

SEQ ID NO: 4746 - protein, 73 aa, Artificial Sequence
  Computer-generated peptide variant
KFRLIRRLWRKIKKKRSAERLWWRAVILNTILALGERRNACNMLMTNACLARNRSWKTLKRAKNAMDGLLRLV

SEQ ID NO: 4747 - protein, 36 aa, Artificial Sequence
  Computer-generated peptide variant
RMRWLRKIFKKFRRGAKALKRRCAPALWILIELIAN

SEQ ID NO: 4748 - protein, 66 aa, Artificial Sequence
  Computer-generated peptide variant
LFKLFCRLIRILKPAKSLQLQQAACLRRAERAFRIMCRKRHRTFHAHADHKKLEVLYAFKTKLKRR

SEQ ID NO: 4749 - protein, 41 aa, Artificial Sequence
  Computer-generated peptide variant
KYKWFRRMIKRWKRAAAQAACKASPLEDFTKKPLLRIILLD

SEQ ID NO: 4750 - protein, 85 aa, Artificial Sequence
  Computer-generated peptide variant
RLRLWPRIFRFLKKMWTKRKWLDARRDDFSKHLAALRQMKVLNFFAATTARRYWRHRRLLEGALMPCAIQPKLGKRKKKRRNAPE

SEQ ID NO: 4751 - protein, 38 aa, Artificial Sequence
  Computer-generated peptide variant
KWKFLRRFMKLFKHVALAQNERAPVLRPAYLRRVILHR

SEQ ID NO: 4752 - protein, 40 aa, Artificial Sequence
  Computer-generated peptide variant
RFRFLHRMIKFFQKLAGLKAKKATLKMLIWRRKCGAILRN

SEQ ID NO: 4753 - protein, 60 aa, Artificial Sequence
  Computer-generated peptide variant
RIKYYKKWYRLWNKRKCKAGKSYGKFFIAAFLYLEAKILKKLAGGLKRREASEAHRAAKC

SEQ ID NO: 4754 - protein, 72 aa, Artificial Sequence
  Computer-generated peptide variant
LIRFLRRWLKFFTRPLQAVEAMLKLKCLRVKWEKANHELLHRKWQALIHCAVRQSLLRAYERRKKAKRMGMR

SEQ ID NO: 4755 - protein, 72 aa, Artificial Sequence
  Computer-generated peptide variant
RMRFFKRFMRRMRRENLIMKKAWLLKLLERFKRRAARRHAFACNLQILTVKMPWDQRAKAEALTLTYWKADK

SEQ ID NO: 4756 - protein, 74 aa, Artificial Sequence
  Computer-generated peptide variant
FLKYIPKYFKRWSKAERFGCVRLKKELLAENKCKFACVRKRTLFAFPDKRLLHKVYHAALVKKAALGLGMRAKR

SEQ ID NO: 4757 - protein, 78 aa, Artificial Sequence
  Computer-generated peptide variant
RIRLYSKLFRILQRLRVLHQKMWAPEKRKVRTRRTWLIAHSLGKLRRSRAGLRMAILAKIKQLIRRMKKANIAQSVTR

SEQ ID NO: 4758 - protein, 68 aa, Artificial Sequence
  Computer-generated peptide variant
RFRFYNKLYKRYRKELLKARQMLAEQHIRNIAKSKKALKSRCSVKWMRRALLALKRAMASAKEARKAN

SEQ ID NO: 4759 - protein, 54 aa, Artificial Sequence
  Computer-generated peptide variant
ILRLFRRLIKWYKHTRMNKLRAVWAFFDKARFREELLKLCLLRADPLANAYANA

SEQ ID NO: 4760 - protein, 40 aa, Artificial Sequence
  Computer-generated peptide variant
KFKILKKLFRRFKNARRVIAALCHGYRANRADAPVIRHRM

SEQ ID NO: 4761 - protein, 34 aa, Artificial Sequence
  Computer-generated peptide variant
RIKLLKRFLRLLRRHPLLWGYPDLEAQRHRWALD

SEQ ID NO: 4762 - protein, 78 aa, Artificial Sequence
  Computer-generated peptide variant
KFKLWQKMLRKWHKRELRARAWWLMRNQAPYTHAPVKKARLAERAFLFMCSRLATRWRLRKSLLNKTCLRARTGRTRA

SEQ ID NO: 4763 - protein, 21 aa, Artificial Sequence
  Computer-generated peptide variant
LMRLWHRFLRLLKPYYRRCRA

SEQ ID NO: 4764 - protein, 40 aa, Artificial Sequence
  Computer-generated peptide variant
LFRIFRRLMKILNRCRNSKLARDHARRRRILVLRIDHAID

SEQ ID NO: 4765 - protein, 22 aa, Artificial Sequence
  Computer-generated peptide variant
RLKMLKKLWRRWKPAAMHKALR

SEQ ID NO: 4766 - protein, 36 aa, Artificial Sequence
  Computer-generated peptide variant
FIRLLRRYWRFIRQIAACNRCTLKLKMLKCHPRRAA

SEQ ID NO: 4767 - protein, 37 aa, Artificial Sequence
  Computer-generated peptide variant
RLKILTKFLKKYKRWKMARPRCANKLWDRLNVALYLE

SEQ ID NO: 4768 - protein, 78 aa, Artificial Sequence
  Computer-generated peptide variant
RIRFLQKLLRRFKREEKDCGRIGVELKFIAKALRRRKFQTRGAAQSPYRRKLWLYKAIAKAASPCMARMKSKILLYKG

SEQ ID NO: 4769 - protein, 23 aa, Artificial Sequence
  Computer-generated peptide variant
KLRMWNRWLRLMRPVWLAKQRLR

SEQ ID NO: 4770 - protein, 29 aa, Artificial Sequence
  Computer-generated peptide variant
FWKLLSRMMKIYPKGLHLRTRRLRVALLN

SEQ ID NO: 4771 - protein, 50 aa, Artificial Sequence
  Computer-generated peptide variant
RLRWIRRLLRFLKKLLLRVKRYMMMRFMAVIRCTQLALLYAKKKARESAL

SEQ ID NO: 4772 - protein, 30 aa, Artificial Sequence
  Computer-generated peptide variant
LLRFLPRLIRKMNQYAKRLRLAPINKAIRC

SEQ ID NO: 4773 - protein, 49 aa, Artificial Sequence
  Computer-generated peptide variant
RYKFLRRLWRRLNSKTWRGKMAWRPDPAEMMKLSALLLRRLARQQRKED

SEQ ID NO: 4774 - protein, 87 aa, Artificial Sequence
  Computer-generated peptide variant
RFRLIRKLLKYMCKAQLDLKKRLWDVKMPSGVRKALKPQKLKLTLGKRWVKYRRLALRLAKFRWKHKAAGSAYAPNDRFMMRAPRFK

SEQ ID NO: 4775 - protein, 21 aa, Artificial Sequence
  Computer-generated peptide variant
LYKLLRKILRFLTRCLDYSKD

SEQ ID NO: 4776 - protein, 63 aa, Artificial Sequence
  Computer-generated peptide variant
RWKLLTKMLRKYHRKRALCKAAAFDFKMRKKWLVSKLKCRRLARADRQALKLQQYVIKKEQPW

SEQ ID NO: 4777 - protein, 69 aa, Artificial Sequence
  Computer-generated peptide variant
KWKLMRKMWRKFKKPWYMETKASHLRLRRARNMLEILANAKAPLQVPDERDLRALPMLKLAVVKNAAIK

SEQ ID NO: 4778 - protein, 20 aa, Artificial Sequence
  Computer-generated peptide variant
LLKFMRRLIKLIHQRRFGLA

SEQ ID NO: 4779 - protein, 29 aa, Artificial Sequence
  Computer-generated peptide variant
KLKLWKRILKRWKTFRLKHALLCRENLPA

SEQ ID NO: 4780 - protein, 45 aa, Artificial Sequence
  Computer-generated peptide variant
KFRLICKLLRRYHRKALLIDAKDKDLKGKSAHKLCSYALLGKVLL

SEQ ID NO: 4781 - protein, 59 aa, Artificial Sequence
  Computer-generated peptide variant
YMRMFRRILKLFQKKSSAHRTALRKKLWELIDGDNLALKNGHERRRPKKLYLSRRGLRA

SEQ ID NO: 4782 - protein, 89 aa, Artificial Sequence
  Computer-generated peptide variant
RYRLMKKFLKRWHRSLLILKRAALEESWYQRARLRTNKRFRARRYQKTLPRLWQRLEKALCIKAQFIALTVLQDKTSFKLKMKNSCEAK

SEQ ID NO: 4783 - protein, 27 aa, Artificial Sequence
  Computer-generated peptide variant
RYKLFQKYLKFYKKWAKQDAKCRNALA

SEQ ID NO: 4784 - protein, 20 aa, Artificial Sequence
  Computer-generated peptide variant
KMKFLNRLLRRWNKAWMCAD

SEQ ID NO: 4785 - protein, 76 aa, Artificial Sequence
  Computer-generated peptide variant
RFRWLPKFMRKIRPASPRCLSDADLHLTSRSWKAFRKIAAALQAARVRARHNALLKTCPNRAALKIKFRAFGKPQA

SEQ ID NO: 4786 - protein, 26 aa, Artificial Sequence
  Computer-generated peptide variant
RMKFFQKLMKLLKKRDALWLFEARII

SEQ ID NO: 4787 - protein, 26 aa, Artificial Sequence
  Computer-generated peptide variant
KLRLMNKLMKLIKNANLKPKIDPLEL

SEQ ID NO: 4788 - protein, 49 aa, Artificial Sequence
  Computer-generated peptide variant
RYRLLRRLFKKLKCAILKKKQLGIAAARRKCQVQRRLDPFWIARIVVRA

SEQ ID NO: 4789 - protein, 61 aa, Artificial Sequence
  Computer-generated peptide variant
RWRLWKRLFRMFRKVEDAIDARVIPAKKVKKRLRHWQAAGAAKALCKWLIDDRAAGLALYF

SEQ ID NO: 4790 - protein, 36 aa, Artificial Sequence
  Computer-generated peptide variant
WLRWLTRLYKLWQQAPVFAANARPKKKRAQAKAGKR

SEQ ID NO: 4791 - protein, 24 aa, Artificial Sequence
  Computer-generated peptide variant
KYRMFRKLLRMLSRILLFRDAVAM

SEQ ID NO: 4792 - protein, 56 aa, Artificial Sequence
  Computer-generated peptide variant
KIRLLRRLFRFLKHLYRWWAAHAALERYDYEKFLRAFNLLKSHVHYLARQRLIKPV

SEQ ID NO: 4793 - protein, 52 aa, Artificial Sequence
  Computer-generated peptide variant
KLRLFRKFLRFLRTDRKMAECARYVARRLLRILMSCATTHGFAKLKQQANRL

SEQ ID NO: 4794 - protein, 88 aa, Artificial Sequence
  Computer-generated peptide variant
KLRWLRRMLRRLRKLAKVWNRKCKRDWAPHWKKLLTKRWAMKTLMARKRPPLKARGEKLMKNLDKIKLIAFCANLACELLRLLRMATQ

SEQ ID NO: 4795 - protein, 38 aa, Artificial Sequence
  Computer-generated peptide variant
KLRLYNKMMKKFCQRKESKPYKTYHPQLAALAKAKARH

SEQ ID NO: 4796 - protein, 37 aa, Artificial Sequence
  Computer-generated peptide variant
WIKIYQKFLRLWKKARTLRAAKNARGWADFKTHKDLL

SEQ ID NO: 4797 - protein, 39 aa, Artificial Sequence
  Computer-generated peptide variant
RIRMLKRLLKFLRRSRHQSLRKCDAAVIANRHLPAWRLF

SEQ ID NO: 4798 - protein, 40 aa, Artificial Sequence
  Computer-generated peptide variant
RFKLLSRFLRLYRKLCWKRGANAESLSAACSKKALCLRCA

SEQ ID NO: 4799 - protein, 58 aa, Artificial Sequence
  Computer-generated peptide variant
RFRFFRKFMRLLSTLLIAIDRLERYLMQRMKRNRAYHVRRIMVFAKMKKRPAALLRAP

SEQ ID NO: 4800 - protein, 52 aa, Artificial Sequence
  Computer-generated peptide variant
RFKIYNRMWRRLRHTQFWRRAAKNCLLQFCLKVKIYMLRLRAAALRRMTLYK

SEQ ID NO: 4801 - protein, 41 aa, Artificial Sequence
  Computer-generated peptide variant
LLRWFKKLLKRWRCRDDADLRVMSKKARFWLVYLLYNGRIL

SEQ ID NO: 4802 - protein, 41 aa, Artificial Sequence
  Computer-generated peptide variant
KLRLFRRYLRRFRKHKQRILEMAKRLYNADPASLNLEYWEL

SEQ ID NO: 4803 - protein, 56 aa, Artificial Sequence
  Computer-generated peptide variant
MLRFIKRLMKIFKKVRTASDVTRHCHKVLLRCWALLCRAVLGDARLRPSAASLLAL

SEQ ID NO: 4804 - protein, 57 aa, Artificial Sequence
  Computer-generated peptide variant
LLRFFKKLIRFWKKAARVRAVSRALAFARILSSKRWRLTCPEHETGKIKAHEKIARA

SEQ ID NO: 4805 - protein, 43 aa, Artificial Sequence
  Computer-generated peptide variant
RYRLLKKWLRFLRCQVRMRAGRARATIARKAHTQSFKASHLKL

SEQ ID NO: 4806 - protein, 67 aa, Artificial Sequence
  Computer-generated peptide variant
LLKFLKRLYRFFPCEYLSCALGKQMKTARVRNQIGLLQRMRALRNLREKGKRLNLKKLTCYRVKWKL

SEQ ID NO: 4807 - protein, 33 aa, Artificial Sequence
  Computer-generated peptide variant
KMKLMCRFFKKWPPSLAALLLLKCADNKMSARK

SEQ ID NO: 4808 - protein, 30 aa, Artificial Sequence
  Computer-generated peptide variant
KLKLYNKFFRFYRPRVRKAELAGHFAADKK

SEQ ID NO: 4809 - protein, 42 aa, Artificial Sequence
  Computer-generated peptide variant
FLRWLQRLLRRFCRRKRCRRPDRKEGTVANALPLKEAAEPRA

SEQ ID NO: 4810 - protein, 29 aa, Artificial Sequence
  Computer-generated peptide variant
LFKYYNRILRRLRHRATMLCYYALPRKKQ

SEQ ID NO: 4811 - protein, 59 aa, Artificial Sequence
  Computer-generated peptide variant
FLRILRRMLKRWKCSLNRFDRLSWHDIAAAKRDLKRARAAQECAIRRKRIARLSSNMGY

SEQ ID NO: 4812 - protein, 30 aa, Artificial Sequence
  Computer-generated peptide variant
MFKFYKRLFKRLRSPKLTALNADQLFRKAS

SEQ ID NO: 4813 - protein, 34 aa, Artificial Sequence
  Computer-generated peptide variant
KYRLIQRLMKWLRKMALWPRKAKKYARAATIPLK

SEQ ID NO: 4814 - protein, 27 aa, Artificial Sequence
  Computer-generated peptide variant
RLKLYHKLYKLMTRAKAIEAKAKGFWW

SEQ ID NO: 4815 - protein, 55 aa, Artificial Sequence
  Computer-generated peptide variant
LIKFLKKFIRKFRRWKEDRLSHDGLAMRDTLTANKSAALADLYLKWRRRRSRLAA

SEQ ID NO: 4816 - protein, 38 aa, Artificial Sequence
  Computer-generated peptide variant
WIRYWKKLFRKLQKKHIQAMEAWAATMLLHKKAARCRA

SEQ ID NO: 4817 - protein, 27 aa, Artificial Sequence
  Computer-generated peptide variant
FLRLFRKFIKRFPRTTMATLKAQLCKL

SEQ ID NO: 4818 - protein, 76 aa, Artificial Sequence
  Computer-generated peptide variant
KLRMLCKLWRMIRSLGESLLYGKVFKVARQARQAVQDRLNENKKLLDRLTKWDHAVAAHAPRRKRQFLKLKADLVL

SEQ ID NO: 4819 - protein, 83 aa, Artificial Sequence
  Computer-generated peptide variant
KLKLLRKFWRRFHKWRNARRGAAVLQTSYRVQARMNLQMQCVNMAKKLAKTRAAKGRKARTRTAMCRFMKAGMLAAIAFMAMK

SEQ ID NO: 4820 - protein, 67 aa, Artificial Sequence
  Computer-generated peptide variant
KYRLIRRLLKILRSKAFRLTRDIEVYMRVVLLALPEKTKIKWHRSLVCAAQRRRKDLKLHDLAAQCW

SEQ ID NO: 4821 - protein, 62 aa, Artificial Sequence
  Computer-generated peptide variant
FYKLYRRLMKKFKHAEKLHRKVLKRWAPHATNATNRNRMANKLLKGLRAMAQWAKRAKRGIK

SEQ ID NO: 4822 - protein, 69 aa, Artificial Sequence
  Computer-generated peptide variant
KIRFFKRWLRLFKRRNNALMRMAAFRAADIIGALDARAMAMRLKRRCRRKQASMTIMRSRLILNADVRL

SEQ ID NO: 4823 - protein, 25 aa, Artificial Sequence
  Computer-generated peptide variant
FFRLMRRLMRYMKSLAPLACMEKRK

SEQ ID NO: 4824 - protein, 23 aa, Artificial Sequence
  Computer-generated peptide variant
LLKFLRRFLRRFQHQPAMELKDK

SEQ ID NO: 4825 - protein, 57 aa, Artificial Sequence
  Computer-generated peptide variant
KLKFLKKIIRIIPNMKLREKACGARIALKRKHEVRCALRAAMTLAAKFMPLVKYRAE

SEQ ID NO: 4826 - protein, 47 aa, Artificial Sequence
  Computer-generated peptide variant
KFRLIRRLLRLMKQIVYKLVAQNLLMDDEKWKTRRLLNMAANRACWR

SEQ ID NO: 4827 - protein, 28 aa, Artificial Sequence
  Computer-generated peptide variant
KIKFLRRFFRRLQSMAGTSLLRAFLWAA

SEQ ID NO: 4828 - protein, 76 aa, Artificial Sequence
  Computer-generated peptide variant
KFRLMRRFIRRLKRNFAHRAMKQTCSKALRIYVACDYATAWAFYARGCAAMPCTFAARLARRLEARTLFLKLLLLM

SEQ ID NO: 4829 - protein, 38 aa, Artificial Sequence
  Computer-generated peptide variant
LWKFLRRYLRKIQKIKNECLLALARWKNAFLFARRRCM

SEQ ID NO: 4830 - protein, 59 aa, Artificial Sequence
  Computer-generated peptide variant
RYRLWCKLLKIYCRYDLQNHRDFMLRALAYVHIRSYLLALRHFRLLTAKAQARKLRRYM

SEQ ID NO: 4831 - protein, 43 aa, Artificial Sequence
  Computer-generated peptide variant
RIKLLKRLFRRMPKYAALPLVEWKLNADMGLLKTKMPRLPKGR

SEQ ID NO: 4832 - protein, 43 aa, Artificial Sequence
  Computer-generated peptide variant
WFKLFPRLFKKYRQRFKAHLVSRLKERADARAPERASHKEKSL

SEQ ID NO: 4833 - protein, 21 aa, Artificial Sequence
  Computer-generated peptide variant
LLKLFSKILKYFKRLKLLAER

SEQ ID NO: 4834 - protein, 35 aa, Artificial Sequence
  Computer-generated peptide variant
LLRFFKRLMRRWTRRRLAKYGAYKTANLPARARVC

SEQ ID NO: 4835 - protein, 32 aa, Artificial Sequence
  Computer-generated peptide variant
IMKLLRKYWRRLRRQKKADLLEQLRKMHLAAV

SEQ ID NO: 4836 - protein, 26 aa, Artificial Sequence
  Computer-generated peptide variant
LIKFLRKFMKLWKPLYKKAKGALIDK

SEQ ID NO: 4837 - protein, 61 aa, Artificial Sequence
  Computer-generated peptide variant
LLRLMSRYFKLFRSAKLIIAALRKVMCRRKAPRRVKFAYPNQQCPKLRCYGALQRKRERDA

SEQ ID NO: 4838 - protein, 29 aa, Artificial Sequence
  Computer-generated peptide variant
KLRYFPRLLKKYCCKNALHSSKYARDLIL

SEQ ID NO: 4839 - protein, 61 aa, Artificial Sequence
  Computer-generated peptide variant
RLRMLSRMMRKWKQGWVKAVRGLLVLDDKRKKWWKAAKLRLMARKFGHNNVKLAVRTALTI

SEQ ID NO: 4840 - protein, 35 aa, Artificial Sequence
  Computer-generated peptide variant
KLRLFKKILKWFKHRRRRLNLAPRERGLFQAWAAR

SEQ ID NO: 4841 - protein, 24 aa, Artificial Sequence
  Computer-generated peptide variant
KLKLYRKYYKWLRSTSNKLAWMLR

SEQ ID NO: 4842 - protein, 20 aa, Artificial Sequence
  Computer-generated peptide variant
RLKILKRFLKWLTRNQNLAK

SEQ ID NO: 4843 - protein, 24 aa, Artificial Sequence
  Computer-generated peptide variant
KLRMIQKLYKKLRRFMSFYAAAAW

SEQ ID NO: 4844 - protein, 44 aa, Artificial Sequence
  Computer-generated peptide variant
FLRFYRRLFKKMRSAARVRAMPLATYAYRKLLLPLKRACNCKTK

SEQ ID NO: 4845 - protein, 47 aa, Artificial Sequence
  Computer-generated peptide variant
FFRFWSRWMKRFCCKPLYASIARLLKRRHLTLFTRAKFLLKRKDLKI

SEQ ID NO: 4846 - protein, 40 aa, Artificial Sequence
  Computer-generated peptide variant
KLKIFRRFLKRLKPSRKLLWMELLCKLQCLCYMAVAMAKQ

SEQ ID NO: 4847 - protein, 30 aa, Artificial Sequence
  Computer-generated peptide variant
KWRFMCRWLKRLTRHSAHFLLCLKQKSKAK

SEQ ID NO: 4848 - protein, 50 aa, Artificial Sequence
  Computer-generated peptide variant
LYRILKRLLRKFKQKRAKRIHRLVAKIDLPKMLIANEYILYITEHVKLAL

SEQ ID NO: 4849 - protein, 34 aa, Artificial Sequence
  Computer-generated peptide variant
LLRIFQRLIKRYKKIKGKGADLAKHLLLSPRSWG

SEQ ID NO: 4850 - protein, 47 aa, Artificial Sequence
  Computer-generated peptide variant
RMRFYRRFWRRLRTNDKAATAKKAMRWKIGRLNKGSALKAADLLVAM

SEQ ID NO: 4851 - protein, 49 aa, Artificial Sequence
  Computer-generated peptide variant
KWKLFQRFLKKFKKKKSASELKPAASFASKCAFHSKRLEGLLLFLGKRA

SEQ ID NO: 4852 - protein, 29 aa, Artificial Sequence
  Computer-generated peptide variant
LLRFITRFIKRMKNMPEGKRLAKLLTKEL

SEQ ID NO: 4853 - protein, 34 aa, Artificial Sequence
  Computer-generated peptide variant
RFKMLPRLWKKFRRPCSILKYLVKALQLLKLERN

SEQ ID NO: 4854 - protein, 68 aa, Artificial Sequence
  Computer-generated peptide variant
KMRFFRRLFRKICRKSPARRARWWDIKKRKKFKKAALLKAARLIVPADKNKAKPPHAAAARHHARAAC

SEQ ID NO: 4855 - protein, 26 aa, Artificial Sequence
  Computer-generated peptide variant
IMRFLRRLLKFFSRKLSLRRRRVAAA

SEQ ID NO: 4856 - protein, 31 aa, Artificial Sequence
  Computer-generated peptide variant
YMKFFKKLFKKIKKWTLRRARADLLYSAKSL

SEQ ID NO: 4857 - protein, 32 aa, Artificial Sequence
  Computer-generated peptide variant
WMKILKRYFKMLKSKRLAKYKAAGLCKYMSAR

SEQ ID NO: 4858 - protein, 22 aa, Artificial Sequence
  Computer-generated peptide variant
LLRLIKKYFRRLSRNELAGDAY

SEQ ID NO: 4859 - protein, 40 aa, Artificial Sequence
  Computer-generated peptide variant
WIRLLTRFLRFMRCAKNRYAAPSLAKRLNLPVWARREKLQ

SEQ ID NO: 4860 - protein, 26 aa, Artificial Sequence
  Computer-generated peptide variant
RLRLITKFLKKYSRLCLFAIWAAYRN

SEQ ID NO: 4861 - protein, 80 aa, Artificial Sequence
  Computer-generated peptide variant
MYRLLKKMFKKFPRPRGKDFRLKCLTLRHRLPSFGYGARNQKLGRAPAKHLSRSKRKKVCRKPPLTKRCAAAGLWLKDAT

SEQ ID NO: 4862 - protein, 20 aa, Artificial Sequence
  Computer-generated peptide variant
RLRIFTKLIRRFHSLPAFRA

SEQ ID NO: 4863 - protein, 29 aa, Artificial Sequence
  Computer-generated peptide variant
WIKFFKKIYKLYKRERAWAQALLTLRKFT

SEQ ID NO: 4864 - protein, 31 aa, Artificial Sequence
  Computer-generated peptide variant
YLKLIHKLLKKFHRVVRARFMGASLRDKLAA

SEQ ID NO: 4865 - protein, 70 aa, Artificial Sequence
  Computer-generated peptide variant
LLKLLNKFFKFYHKRRLRLTARVRWVLKAAPRKEGSRCRPQDKAKQRLPCINLVHRQRYRGKKKAYANLE

SEQ ID NO: 4866 - protein, 53 aa, Artificial Sequence
  Computer-generated peptide variant
RFKLLTRLWRIMKKLEQRIRMKAWGRALKNRNSSLHWKDRLHALRANARFKRV

SEQ ID NO: 4867 - protein, 36 aa, Artificial Sequence
  Computer-generated peptide variant
KLKYLKKFMRLLRCAPGKRKDARVIYVHRMAIYLAM

SEQ ID NO: 4868 - protein, 30 aa, Artificial Sequence
  Computer-generated peptide variant
MLKLLKKFYRWLHCGRSRRHIWLQRLTALA

SEQ ID NO: 4869 - protein, 40 aa, Artificial Sequence
  Computer-generated peptide variant
KYKLLKKFYKRIRKTNWAHARKLYQIKELGALLHALWILL

SEQ ID NO: 4870 - protein, 40 aa, Artificial Sequence
  Computer-generated peptide variant
KLRYFKRMMKMIRTRWMKRLKDRPVIYAALALSYLRSLEL

SEQ ID NO: 4871 - protein, 21 aa, Artificial Sequence
  Computer-generated peptide variant
RLKIMPKLLKFFRKLNGCRSA

SEQ ID NO: 4872 - protein, 29 aa, Artificial Sequence
  Computer-generated peptide variant
KLRFLRRFYKWLQQLALLFPRKMRHLMTI

SEQ ID NO: 4873 - protein, 35 aa, Artificial Sequence
  Computer-generated peptide variant
MFRILRKLMKLLKRFNDSGADKRLDRPAFSLRKNL

SEQ ID NO: 4874 - protein, 23 aa, Artificial Sequence
  Computer-generated peptide variant
KLRLLKRMFRLYRQLNKFGQYVA

SEQ ID NO: 4875 - protein, 25 aa, Artificial Sequence
  Computer-generated peptide variant
RFRFMRKIWRLLTHAKLIMAAYAKK

SEQ ID NO: 4876 - protein, 96 aa, Artificial Sequence
  Computer-generated peptide variant
KLKLFPRIWKWIRRLAHAYALAAIAMKALPMRALCLTSFALRKLAPVASKRGRSYLYHRLQANRLYFKRLSALVWRKRQWKTKKVWAAALLKNDER

SEQ ID NO: 4877 - protein, 36 aa, Artificial Sequence
  Computer-generated peptide variant
KLKFLTKFLKKLTKLCKLDLALDVSYAQKRCAAFYN

SEQ ID NO: 4878 - protein, 49 aa, Artificial Sequence
  Computer-generated peptide variant
LFRLMPKWLRRLQNWHAAKRRKLSIEHRNWYLRGLLRAYLAFTWWLEKR

SEQ ID NO: 4879 - protein, 23 aa, Artificial Sequence
  Computer-generated peptide variant
WFRLLRKMLRFFQRFSRRASALQ

SEQ ID NO: 4880 - protein, 28 aa, Artificial Sequence
  Computer-generated peptide variant
FMRMFKKMLKLLKTMKMLEAHLKLLKHR

SEQ ID NO: 4881 - protein, 25 aa, Artificial Sequence
  Computer-generated peptide variant
KLRMLNKFIRWFTTRRHAARLLLRE

SEQ ID NO: 4882 - protein, 47 aa, Artificial Sequence
  Computer-generated peptide variant
IMRLLKRLIRRLNRLAVHKSPNAALKKRLCLFKWQKAKWPTTMSLRA

SEQ ID NO: 4883 - protein, 35 aa, Artificial Sequence
  Computer-generated peptide variant
LIKWMRRMWKRLCKYRLRAAKLKCSLFCYKDVLLA

SEQ ID NO: 4884 - protein, 53 aa, Artificial Sequence
  Computer-generated peptide variant
KWKYFSKWMRKFHPHLSKLALILAAMIVLPKLKRLKELMFPRKRAKYEKKLLK

SEQ ID NO: 4885 - protein, 34 aa, Artificial Sequence
  Computer-generated peptide variant
KYRLLRRLFKMLRRAAAGLKRSKITCPEAGARYN

SEQ ID NO: 4886 - protein, 30 aa, Artificial Sequence
  Computer-generated peptide variant
RFRLYRRIWKRLNKRKLAMGKVAALTMNNL

SEQ ID NO: 4887 - protein, 67 aa, Artificial Sequence
  Computer-generated peptide variant
KLRWWKRMLRLLRKPINEKVAALRKNCWRYYLVHKNRKLARKNKRQWLKYRLMWRLGYMLLLMKKVL

SEQ ID NO: 4888 - protein, 24 aa, Artificial Sequence
  Computer-generated peptide variant
ILKFMRKLYRKFSKRVALVTRLFA

SEQ ID NO: 4889 - protein, 33 aa, Artificial Sequence
  Computer-generated peptide variant
KYRILTRLFKRLRKLAASCIASIYRYFAKTKRT

SEQ ID NO: 4890 - protein, 40 aa, Artificial Sequence
  Computer-generated peptide variant
MLRYFCRLMKRLQRLRPGFILARVKQIRAMQAAAKLCKRT

SEQ ID NO: 4891 - protein, 61 aa, Artificial Sequence
  Computer-generated peptide variant
YLRMYRRLIRKLQKPKRELWAMERVRVTFEVARLWQKLAKCYGLLHLLLLTARLALPGCYK

SEQ ID NO: 4892 - protein, 35 aa, Artificial Sequence
  Computer-generated peptide variant
RLKYLRKFLKKIRRELRILDMAILKEIKTCLLVRA

SEQ ID NO: 4893 - protein, 37 aa, Artificial Sequence
  Computer-generated peptide variant
YYRLLTKYFKLYKKAAAAEARHTLLTKRYKMKAGHAL

SEQ ID NO: 4894 - protein, 45 aa, Artificial Sequence
  Computer-generated peptide variant
RLRLFRKLFKLWRKKSLQRVAKLARGLNLKVWRAWAKLRRWAYHR

SEQ ID NO: 4895 - protein, 61 aa, Artificial Sequence
  Computer-generated peptide variant
KIKWYKKYIRILPKKNERRVRKCARVMAAANALRQLALKNAKKIALGKFYWKASARTRLVY

SEQ ID NO: 4896 - protein, 59 aa, Artificial Sequence
  Computer-generated peptide variant
RIKILQRLFKRLRKLCFALATRCFRRPQTLAMQVLRLLAKHKFYTRAIVAAEDDKKYAR

SEQ ID NO: 4897 - protein, 53 aa, Artificial Sequence
  Computer-generated peptide variant
RIRFMHRLLKFLRKALSYKNCRKRRGHTAKVKEKLIMSSWKKNLVPQAKLLLA

SEQ ID NO: 4898 - protein, 44 aa, Artificial Sequence
  Computer-generated peptide variant
LLRWIQRLYRIYRSKAKKATAHEIKKLDILRKARWLLRGAFCKR

SEQ ID NO: 4899 - protein, 45 aa, Artificial Sequence
  Computer-generated peptide variant
LYKILSRFIRWWSHRLLAIKAALPALRRIRSACTAFEKLARARKH

SEQ ID NO: 4900 - protein, 34 aa, Artificial Sequence
  Computer-generated peptide variant
RFKLLKRLLKYFPHMAAKTAKETQFLKSAIRLMR

SEQ ID NO: 4901 - protein, 25 aa, Artificial Sequence
  Computer-generated peptide variant
YLRLFRRLMRKFKKLGALKGCYARL

SEQ ID NO: 4902 - protein, 28 aa, Artificial Sequence
  Computer-generated peptide variant
ILKFLCRLFRRYHQAKARKKTRSLWLWN

SEQ ID NO: 4903 - protein, 29 aa, Artificial Sequence
  Computer-generated peptide variant
YLRFIKKLLRRFTQWRVFLLACKKRDIMA

SEQ ID NO: 4904 - protein, 38 aa, Artificial Sequence
  Computer-generated peptide variant
YLRIWRKMLRKYKKAYAADLLIRNHKMQWPKLRQIEAA

SEQ ID NO: 4905 - protein, 70 aa, Artificial Sequence
  Computer-generated peptide variant
RIRLFRRFYRRLRQARKMATRLKRIALLKNAGQLPSQKKAARAKLPLALVMRDCHACALNRTRTCMKNGM

SEQ ID NO: 4906 - protein, 24 aa, Artificial Sequence
  Computer-generated peptide variant
KFKLLKKFYRRLKNRPLHAVTVTL

SEQ ID NO: 4907 - protein, 52 aa, Artificial Sequence
  Computer-generated peptide variant
LFKLMKKMMKRLRCCGDAPELCRLRTALMWLRKAKTIKNDFRLCLVRLAYKR

SEQ ID NO: 4908 - protein, 38 aa, Artificial Sequence
  Computer-generated peptide variant
WIKFLRRLLKYLKKLKSIAYFKLPAKWGAIKRIEPHTA

SEQ ID NO: 4909 - protein, 24 aa, Artificial Sequence
  Computer-generated peptide variant
WFRYLRRLFRRLKKKALWFRIILA

SEQ ID NO: 4910 - protein, 68 aa, Artificial Sequence
  Computer-generated peptide variant
KMRLIKKLLKRFRKTRRALLQANLILCGAGALTNLRFNKNKHVLVDRFAQPREIKKATLAAAQHTQAL

SEQ ID NO: 4911 - protein, 43 aa, Artificial Sequence
  Computer-generated peptide variant
KFRFLRKLYRKIHKAICKLKPKAAPEGDHKLAWKAPMGACLRK

SEQ ID NO: 4912 - protein, 32 aa, Artificial Sequence
  Computer-generated peptide variant
LLRLIKRFIRRLKKPGDCKKAIPAPLLPETKR

SEQ ID NO: 4913 - protein, 37 aa, Artificial Sequence
  Computer-generated peptide variant
KFRLLRKMLKMYRRYDHALRARVRRVCSHLLPALMKN

SEQ ID NO: 4914 - protein, 30 aa, Artificial Sequence
  Computer-generated peptide variant
FLRLLQKYYKMLRKKRTNCRIGLFLAYKRA

SEQ ID NO: 4915 - protein, 45 aa, Artificial Sequence
  Computer-generated peptide variant
RLRYLRKLLKILRKHLYMWIHSHLLKKQEIAKNYLLAGHLPKRHP

SEQ ID NO: 4916 - protein, 37 aa, Artificial Sequence
  Computer-generated peptide variant
WMRLIPRLLRWFKCPDVHSRLDKLNQLLLLKAKIRAK

SEQ ID NO: 4917 - protein, 46 aa, Artificial Sequence
  Computer-generated peptide variant
LFRLIRKWLKWMKKKTKLDLLTLTSKWKRSAYPLKAEYARTLLPRR

SEQ ID NO: 4918 - protein, 38 aa, Artificial Sequence
  Computer-generated peptide variant
FLRWLRRLMKKYTRFNIKQKFRKYDLAKELYMAKAVAP

SEQ ID NO: 4919 - protein, 20 aa, Artificial Sequence
  Computer-generated peptide variant
ILKYIKKFFKWLKRPAAATP

SEQ ID NO: 4920 - protein, 87 aa, Artificial Sequence
  Computer-generated peptide variant
LYRLLKRIFRKLRRDLKYKRTFDRRKLKLQRMRDRKRILLNDKSHKVQCNTVLHETLLYKLAYRKALELRLHMATKIPAKQFTQPKH

SEQ ID NO: 4921 - protein, 30 aa, Artificial Sequence
  Computer-generated peptide variant
LMRWFHRLMRLLKHRCKKLLCRILRNFLKG

SEQ ID NO: 4922 - protein, 28 aa, Artificial Sequence
  Computer-generated peptide variant
RYKLWKKIWKLLKTKFRHKLMVDLRLLL

SEQ ID NO: 4923 - protein, 27 aa, Artificial Sequence
  Computer-generated peptide variant
LWKLMQKLFRMYTKVRLIRAAEAKQFL

SEQ ID NO: 4924 - protein, 21 aa, Artificial Sequence
  Computer-generated peptide variant
RLKFLNRMMKKFRQLYKVCLL

SEQ ID NO: 4925 - protein, 96 aa, Artificial Sequence
  Computer-generated peptide variant
FMRFLKRFFRKINSGYLRALAAAEAKPILTHDRNIKRDCLKLANGLKLIREADTRVKLPSVLLWVRCKPAKLAKALAPHLQLQKIRCWKELKKLPL

SEQ ID NO: 4926 - protein, 43 aa, Artificial Sequence
  Computer-generated peptide variant
IFKWLKRYLRRLRHYAGSRMRAKLRIMLKPSTFNLHKNRRAAT

SEQ ID NO: 4927 - protein, 33 aa, Artificial Sequence
  Computer-generated peptide variant
KLKWWPKFLRKYKKAWERAHRALRPQALMPLQR

SEQ ID NO: 4928 - protein, 78 aa, Artificial Sequence
  Computer-generated peptide variant
RYKFWSKLYKLFRRRLALAKRKQLYGQATFPAAGTALYKHRKIRQRKGKLRAFYALAYRDRRDGRANAKSQAACALKP

SEQ ID NO: 4929 - protein, 25 aa, Artificial Sequence
  Computer-generated peptide variant
KIKLLSKLLKLIRRQGDLRNLLNKN

SEQ ID NO: 4930 - protein, 36 aa, Artificial Sequence
  Computer-generated peptide variant
KLRLWKRMLKRLRRFTCKKLDVSMAYMLVLRLQKTE

SEQ ID NO: 4931 - protein, 63 aa, Artificial Sequence
  Computer-generated peptide variant
RWRYLKKLFKKLPNLRRCKRLRLACIDHLLRRSARRFRQAKFRNPRLQWKMQFVCEALDVLGR

SEQ ID NO: 4932 - protein, 23 aa, Artificial Sequence
  Computer-generated peptide variant
FLRYYRRMMRFLTKKLTLERDAL

SEQ ID NO: 4933 - protein, 89 aa, Artificial Sequence
  Computer-generated peptide variant
KLRIFRRLIRLFRRRGQRLHADLTKLSGPDAAQCMAPIRAAKRCQLLKWAIRLKQWRPGKKCLWLTPFARRHALAVRPRRLHSKGKAKL

SEQ ID NO: 4934 - protein, 56 aa, Artificial Sequence
  Computer-generated peptide variant
WLRLIRRYLRLWKRKAVKVRFHLSTPWPALDKTTTARLATRRKDEAKTVLRSLAKR

SEQ ID NO: 4935 - protein, 25 aa, Artificial Sequence
  Computer-generated peptide variant
LLRLWRRFYRRWQHTVLKLRRSALL

SEQ ID NO: 4936 - protein, 51 aa, Artificial Sequence
  Computer-generated peptide variant
RFKIFRRYFRLFHRAALLKKLYVKRVLRAAYKLLMTRWKLDVVLLGWGLAK

SEQ ID NO: 4937 - protein, 45 aa, Artificial Sequence
  Computer-generated peptide variant
RMRMFKKILKKFKKRLLLKAYDLYLWLDAHCEKRCHAYTLTFKAK

SEQ ID NO: 4938 - protein, 34 aa, Artificial Sequence
  Computer-generated peptide variant
RLKWLTRILRRLKTDISAREANCIHAALRWEAQR

SEQ ID NO: 4939 - protein, 79 aa, Artificial Sequence
  Computer-generated peptide variant
KYKFLKRIYRIIKPKMMRLFALGALQGARILANLASALRAEGFNICKRHALRYLKKRRLGRLRRLFNHRRHDKRKLDCQ

SEQ ID NO: 4940 - protein, 62 aa, Artificial Sequence
  Computer-generated peptide variant
FYKMMRKLFKLLCKKFAKKLKRRKIIMAWAPHAHSRNRMKAFKNESRQAAFAQLYCALRALF

SEQ ID NO: 4941 - protein, 65 aa, Artificial Sequence
  Computer-generated peptide variant
FWRMLKRYLRKFRTKKPKYSLLALSPMKKLLENCAKGGYALCLSKMKPFLDHDRLRKADLSARRV

SEQ ID NO: 4942 - protein, 70 aa, Artificial Sequence
  Computer-generated peptide variant
FFRFMNRMWRKFKNKWFLVKLRKKILEARMRVALKKRHRLAWKLCKYHKLARQANAELGKTKLFNKADPV

SEQ ID NO: 4943 - protein, 95 aa, Artificial Sequence
  Computer-generated peptide variant
RLRLFKKWLRYMKKVAGGRKWVKTDKLFLKKPYKQRLALRFRCCLKNRAPAGYDWGTRAKLAKTVAWADVRQAKGLLTRFEKLRAKQWNLDKKAR

SEQ ID NO: 4944 - protein, 37 aa, Artificial Sequence
  Computer-generated peptide variant
KYKILRKLFRKYRSLLQASQHALRLRMAAVFKQLLQR

SEQ ID NO: 4945 - protein, 29 aa, Artificial Sequence
  Computer-generated peptide variant
LLKLWKKFFKRMTKLAIRSALKYIALRKY

SEQ ID NO: 4946 - protein, 31 aa, Artificial Sequence
  Computer-generated peptide variant
RFRYLNKLIRRLHRRTADKMLAVCHPLSLAR

SEQ ID NO: 4947 - protein, 27 aa, Artificial Sequence
  Computer-generated peptide variant
LLKLLKRYFRLMCKHNLKAWLYHRAGT

SEQ ID NO: 4948 - protein, 49 aa, Artificial Sequence
  Computer-generated peptide variant
LWRLFQRLMKLFKSSNLALLWRPFLRLKKMDRHKAARKAMQYKDSASYS

SEQ ID NO: 4949 - protein, 60 aa, Artificial Sequence
  Computer-generated peptide variant
MLKMFRKFIKKMKSFAAYAKAHRHLKKAAKADGRLGKPLKHHTADRLLKMVQRTDLRMLC

SEQ ID NO: 4950 - protein, 31 aa, Artificial Sequence
  Computer-generated peptide variant
RFKLWRKLMRRLTRKSAMRLELIAPKATVAA

SEQ ID NO: 4951 - protein, 47 aa, Artificial Sequence
  Computer-generated peptide variant
MYRLIKRLLKMLCKRGRSMRSLYLAKHLNCAACAAGALCFQDHKLDK

SEQ ID NO: 4952 - protein, 40 aa, Artificial Sequence
  Computer-generated peptide variant
RYKLLCKLLRLWKCTQKLLTKARRYLPLEKCHLTKYPMIG

SEQ ID NO: 4953 - protein, 54 aa, Artificial Sequence
  Computer-generated peptide variant
KWKLWKKYWRIFKCWNHLRLYRMQYPTKAFRCPARALDKKRAKARKPLIQARAL

SEQ ID NO: 4954 - protein, 35 aa, Artificial Sequence
  Computer-generated peptide variant
KFRFLRKILKLLKKLAPLAKRSLKPFTAYFNYQAC

SEQ ID NO: 4955 - protein, 45 aa, Artificial Sequence
  Computer-generated peptide variant
MLKFLHRLLKFLRQLAVQCISLYCKMKLDDARVAPKSPRLRRKVA

SEQ ID NO: 4956 - protein, 29 aa, Artificial Sequence
  Computer-generated peptide variant
FLKLLKKFFRRLKTRKPPAQLPKVRAHDL

SEQ ID NO: 4957 - protein, 71 aa, Artificial Sequence
  Computer-generated peptide variant
RLKILHRLFKKLRQRMRNQRSSLADDQLFLSAKEQLYKRWIGADLLTMRAARPPKRAKARQEARRRIGRWR

SEQ ID NO: 4958 - protein, 27 aa, Artificial Sequence
  Computer-generated peptide variant
FLRLLRKFFRMYRSALKTRLSVFRARM

SEQ ID NO: 4959 - protein, 33 aa, Artificial Sequence
  Computer-generated peptide variant
FMRMLSRLFRKLNQQARKRDKGCLAKIRFADKL

SEQ ID NO: 4960 - protein, 50 aa, Artificial Sequence
  Computer-generated peptide variant
RMKLWPKLFRRMKRKRIKLTLIWLRHLKCKSSGLLKARVKSQLNALLVQS

SEQ ID NO: 4961 - protein, 54 aa, Artificial Sequence
  Computer-generated peptide variant
KYKYLNKLLKKMCPIANRFAAAGNHVFLRNSLDTLKAKSHKMLAGLRAKILFKK

SEQ ID NO: 4962 - protein, 22 aa, Artificial Sequence
  Computer-generated peptide variant
LLRLLHRLMRYLNKKVFAHCDR

SEQ ID NO: 4963 - protein, 89 aa, Artificial Sequence
  Computer-generated peptide variant
LFRFWKKIFRRFRTRLWFSLWWALSAVRKNSLNENKPLAKRKLALWDQKKKCIKKTILRYYKRADLATALLLRSYNQKHMNKKRGPAAL

SEQ ID NO: 4964 - protein, 96 aa, Artificial Sequence
  Computer-generated peptide variant
KLKFLKRFFRRIKRKGIAYLIALLPRKMKPVQMMKAAALARLEKCAREFKKRLRRKACKKWLRHAPAFAFFRSAGWPKTKPFAKRLNWSAEKFEEC

SEQ ID NO: 4965 - protein, 62 aa, Artificial Sequence
  Computer-generated peptide variant
KLKFIRRILKRWRKCATYALKRRRARLPWDRLGACDCVYNNLDLHRKLRRECLRKCVKLLWN

SEQ ID NO: 4966 - protein, 20 aa, Artificial Sequence
  Computer-generated peptide variant
IMKFFRKLFKKLRSFLAPAT

SEQ ID NO: 4967 - protein, 76 aa, Artificial Sequence
  Computer-generated peptide variant
LIKLIPKILRRLRHEKQKALVKHYRQCLNDAARAHYLRLTKLKVWRLKGKRLAKADNKMMLYLANLSKAKLIGKKR

SEQ ID NO: 4968 - protein, 53 aa, Artificial Sequence
  Computer-generated peptide variant
KFRFMKRLFKRWKKLMMKNAVMLAHRLLAAACNLRYRLTVDCVRFAAADQARM

SEQ ID NO: 4969 - protein, 39 aa, Artificial Sequence
  Computer-generated peptide variant
KLRLLRRLYKRFKKKHSMRRTAKVEAAYVWSALAWHFNS

SEQ ID NO: 4970 - protein, 33 aa, Artificial Sequence
  Computer-generated peptide variant
KWRLFRRMMRLLRSLQANCLRWKAVMALQLMQA

SEQ ID NO: 4971 - protein, 32 aa, Artificial Sequence
  Computer-generated peptide variant
KLKMIRRLLRYLRHKPRTVLLAVCPPLAEIVK

SEQ ID NO: 4972 - protein, 47 aa, Artificial Sequence
  Computer-generated peptide variant
YLKYLRRFFKKLKHMKRRNAVLRAKEKADVLANGREMKLLAVQLNIF

SEQ ID NO: 4973 - protein, 80 aa, Artificial Sequence
  Computer-generated peptide variant
LLRWFSKFFRIIQPKNRAGRRGRHLLKKLQKMACACAKQKKRKDALLAYVQHCLAKGSVRLKRWLEKTDYCLAGKRTAHA

SEQ ID NO: 4974 - protein, 53 aa, Artificial Sequence
  Computer-generated peptide variant
RIKLMRRWMRMWSRRNMRCWRENKWDLLLARLLAAKKLKLNLAKCYQIKCMKR

SEQ ID NO: 4975 - protein, 31 aa, Artificial Sequence
  Computer-generated peptide variant
YMKLLKKIYKRMKRTRLAALNLIDARMALPI

SEQ ID NO: 4976 - protein, 29 aa, Artificial Sequence
  Computer-generated peptide variant
KWRFIKKLLKKMKKLVAEKLALVPRFAVE

SEQ ID NO: 4977 - protein, 47 aa, Artificial Sequence
  Computer-generated peptide variant
KFKLLCRLMKKLKHRKHACRANRQKGLQGDLYWLYRKQKGLKMLAIA

SEQ ID NO: 4978 - protein, 31 aa, Artificial Sequence
  Computer-generated peptide variant
FLRLIRKLLKKLKRFDFKTANAKAPMRMIIP

SEQ ID NO: 4979 - protein, 52 aa, Artificial Sequence
  Computer-generated peptide variant
KFKMLKRLYKKYKSKMLAARRSYGTLHSAAFARQVSYLKHDYHKRWKKLHLR

SEQ ID NO: 4980 - protein, 92 aa, Artificial Sequence
  Computer-generated peptide variant
KLRLLNKLLKRIRTIMRRCLAFKAVSAKKMVGDRYSYAAILNYLKEEPPVAGVKYAKRKPRALCSRVLLKAMHFCFGKLLQKKEKKYKVALK

SEQ ID NO: 4981 - protein, 94 aa, Artificial Sequence
  Computer-generated peptide variant
FLKLIHRMLKYLRRERRSMRKYRWRILNLMLVAALQMKILLATLLADKKFGFDDKMRFLALTKIAKHRRIRSRKWRVKYCHFRNNKRLATLALP

SEQ ID NO: 4982 - protein, 36 aa, Artificial Sequence
  Computer-generated peptide variant
RFKFMQRLLRKFCHLARRAVPPADAKTAYKCLGAKL

SEQ ID NO: 4983 - protein, 74 aa, Artificial Sequence
  Computer-generated peptide variant
MLRMLKRMLRRLRKIEACAARRLCKSKLYGKRANYSATKLIVKRAKQLLMLLELFVYHGRKLKWSKTRASKPYK

SEQ ID NO: 4984 - protein, 33 aa, Artificial Sequence
  Computer-generated peptide variant
RWKMYKKYYRRMKRGLDGLATTADIKLALRLLR

SEQ ID NO: 4985 - protein, 38 aa, Artificial Sequence
  Computer-generated peptide variant
LLKLMQRFLRRYPSLRFAAARWDRANKTITRLWRASRW

SEQ ID NO: 4986 - protein, 59 aa, Artificial Sequence
  Computer-generated peptide variant
RIKFLTKLLRKLKQGAAKQCDYLSWKDRWTRYRCKACLLIYLERARKLGAAFHALFVCK

SEQ ID NO: 4987 - protein, 35 aa, Artificial Sequence
  Computer-generated peptide variant
WIRFYKKLYRRWHTLKRLAAAIRALLWKAHTKQKC

SEQ ID NO: 4988 - protein, 41 aa, Artificial Sequence
  Computer-generated peptide variant
RFKLFPKLLKLLKQAPLKALARWITVLLKRKAKLEPAVPGN

SEQ ID NO: 4989 - protein, 40 aa, Artificial Sequence
  Computer-generated peptide variant
RFKFLRKMIRLMPSAKLRRLLDTFAKLSERAWHSGRKLAL

SEQ ID NO: 4990 - protein, 28 aa, Artificial Sequence
  Computer-generated peptide variant
RLKFYRRMMRLIRRAMLALWKTRAQFAV

SEQ ID NO: 4991 - protein, 20 aa, Artificial Sequence
  Computer-generated peptide variant
RWRLLSRLWKRYRKMAIANQ

SEQ ID NO: 4992 - protein, 21 aa, Artificial Sequence
  Computer-generated peptide variant
RFRWFRRWMRKFRKLLLTLAA

SEQ ID NO: 4993 - protein, 51 aa, Artificial Sequence
  Computer-generated peptide variant
KLRYLKRLIRWIRRLATMFLLAVPYDGKDRSKEIRWDEALAARRQKATAFK

SEQ ID NO: 4994 - protein, 58 aa, Artificial Sequence
  Computer-generated peptide variant
RIRLWRRIYRLFKRRMFATANAVHAPRRPLRLQLARAAPVVWTARLNMRKAWRPANDP

SEQ ID NO: 4995 - protein, 58 aa, Artificial Sequence
  Computer-generated peptide variant
MLRFLHRFIKKINKKLRLRHWAEPMAKRKWGMAARWNLKLAAMKELPVALLTKRVKKK

SEQ ID NO: 4996 - protein, 44 aa, Artificial Sequence
  Computer-generated peptide variant
KMRMWRKILRKFNKRMKYLLSQKIILLLRLKRGLHDAASLEPMR

SEQ ID NO: 4997 - protein, 65 aa, Artificial Sequence
  Computer-generated peptide variant
RLKLLPKLWRKFNHGKGYILLQYRAKAARKLAFVNTSRFRRRQAFNIAQKAPALRRENDARRDAW

SEQ ID NO: 4998 - protein, 62 aa, Artificial Sequence
  Computer-generated peptide variant
RLKIFRKIMRLFKRPRRLLKYLCFCIDIKLASMKALDGHDLAAARGTRLEKAWKAILVFERR

SEQ ID NO: 4999 - protein, 22 aa, Artificial Sequence
  Computer-generated peptide variant
KLRWFKRYLRIIHQRAACATKL

SEQ ID NO: 5000 - protein, 29 aa, Artificial Sequence
  Computer-generated peptide variant
RLRWWCKFLKYLQTFMGKALAHRALATKN

SEQ ID NO: 5001 - protein, 25 aa, Artificial Sequence
  Computer-generated peptide variant
KLKWLKRFLKKYKNEALMWKLTCLF

SEQ ID NO: 5002 - protein, 21 aa, Artificial Sequence
  Computer-generated peptide variant
LYRLLRKFWKLLQKIQRCIKA

SEQ ID NO: 5003 - protein, 26 aa, Artificial Sequence
  Computer-generated peptide variant
FLKYWNRIWRFLKRALAHEKHLCRKL

SEQ ID NO: 5004 - protein, 20 aa, Artificial Sequence
  Computer-generated peptide variant
FMRLWQRLLRLFRHALYSLR

SEQ ID NO: 5005 - protein, 73 aa, Artificial Sequence
  Computer-generated peptide variant
RFRWLKRLLRRFKCLDATNRKRGKQATPFQLPRSQAAAQFACCILLPKSRDLKKKNKRLARVAKYLQTHRKMA

SEQ ID NO: 5006 - protein, 49 aa, Artificial Sequence
  Computer-generated peptide variant
RFKFFRRMFKLWKRLAALAKKLKALALLGRRIKAFRVGKCHRGGAQHLF

SEQ ID NO: 5007 - protein, 27 aa, Artificial Sequence
  Computer-generated peptide variant
RLRFLTRLFKRWKTPAAACRAKHLKTR

SEQ ID NO: 5008 - protein, 25 aa, Artificial Sequence
  Computer-generated peptide variant
LMKFYKRMFKIYRKAFAKKADLGVA

SEQ ID NO: 5009 - protein, 40 aa, Artificial Sequence
  Computer-generated peptide variant
YYRFLSKLWKKLRRWTLRRRGQGLNDQLANARVVAKFRKN

SEQ ID NO: 5010 - protein, 25 aa, Artificial Sequence
  Computer-generated peptide variant
RFKILRRLWKFMRRAAALPKHGRLM

SEQ ID NO: 5011 - protein, 36 aa, Artificial Sequence
  Computer-generated peptide variant
MFRLLSKIIRWFHKARRAHLLASTRFAVKAGRNRLY

SEQ ID NO: 5012 - protein, 33 aa, Artificial Sequence
  Computer-generated peptide variant
KFKLLQRIIRKYRRGWGVPAARALYRSGLATLL

SEQ ID NO: 5013 - protein, 48 aa, Artificial Sequence
  Computer-generated peptide variant
KWKLIKKLLKYLQKSGWFRRTHKATAFLGRMRISWARVARLQRRKFLA

SEQ ID NO: 5014 - protein, 37 aa, Artificial Sequence
  Computer-generated peptide variant
KLRLFKRYMRLWRKLNVNHEACAQAWAKKELFRAKEC

SEQ ID NO: 5015 - protein, 26 aa, Artificial Sequence
  Computer-generated peptide variant
LLRLFRKWYRFLNNKRRHLARNLFDA

SEQ ID NO: 5016 - protein, 68 aa, Artificial Sequence
  Computer-generated peptide variant
KWKWLKKILRKFKSAMDKAEWCLNSGAKQNTIMAFLRMKKRTKFCANGRHVRVQARALADRALRAAKA

SEQ ID NO: 5017 - protein, 53 aa, Artificial Sequence
  Computer-generated peptide variant
IYKFFNRLIKFYRRKLNLPKAGPAERANAKRLRTKRALCVYKYKKKPAAYNRL

SEQ ID NO: 5018 - protein, 53 aa, Artificial Sequence
  Computer-generated peptide variant
RFRYLKRLLRKFKQLHRRLLIPQLQWLWYLLLTAKPLNRSGAFKPALLEKVLQ

SEQ ID NO: 5019 - protein, 41 aa, Artificial Sequence
  Computer-generated peptide variant
LLRFWKKYFKLLHPAELCQRALYRALRAVASKLLVINKKRE

SEQ ID NO: 5020 - protein, 70 aa, Artificial Sequence
  Computer-generated peptide variant
RLKWYSRYFRKFKRLKRILIAKLQNRTHYLPARKKWARATKLLGARADGYDEDLALIANDNRAAERQRVS

SEQ ID NO: 5021 - protein, 32 aa, Artificial Sequence
  Computer-generated peptide variant
FFKILTRYWKLMKKLLKAKSAKREYIKNANAV

SEQ ID NO: 5022 - protein, 81 aa, Artificial Sequence
  Computer-generated peptide variant
LLRLIKRIYKKLHRKLFMLRLARQWRRTPWWVLIDFLLVVWRRRKLRLAGHRKKHAMRKVFDSLEAKYIAQNKYRNQKAIA

SEQ ID NO: 5023 - protein, 33 aa, Artificial Sequence
  Computer-generated peptide variant
LFKILKRFYRWLKKLHYLLEGDPRLARLRQIKG

SEQ ID NO: 5024 - protein, 55 aa, Artificial Sequence
  Computer-generated peptide variant
KLKYLSRLFRRLKRRLRAKLRNKMAYASRAFNAKGWLILHQRLNANVLLQKEKKK

SEQ ID NO: 5025 - protein, 38 aa, Artificial Sequence
  Computer-generated peptide variant
RIKLLRRLFRWWPKIETYNAAHRKYWHAKKLESLAKCA

SEQ ID NO: 5026 - protein, 40 aa, Artificial Sequence
  Computer-generated peptide variant
KIRYYRRLLRRWCSRVAALLMDLSMDRMKAAWACLLLRLE

SEQ ID NO: 5027 - protein, 55 aa, Artificial Sequence
  Computer-generated peptide variant
KWRFLRKLYRLLRNNLANALNRRFGFKSDRIKMWALKKIRLMVFGKGKQAAPGRL

SEQ ID NO: 5028 - protein, 60 aa, Artificial Sequence
  Computer-generated peptide variant
KIKYFRRYIKLFNRLKAKVDLFKILALYRLRKQFALSALQNLRWKELFSDICLQAAPRCL

SEQ ID NO: 5029 - protein, 56 aa, Artificial Sequence
  Computer-generated peptide variant
KLKFLRRFFRKFKRLLQKRAYRWIAKALKALVHLFARLERACVELYASEAATWKDK

SEQ ID NO: 5030 - protein, 40 aa, Artificial Sequence
  Computer-generated peptide variant
IFKFWRKILKFLKKAAHALRGEKAAKVQRMRKQLAWSRDG

SEQ ID NO: 5031 - protein, 74 aa, Artificial Sequence
  Computer-generated peptide variant
LMKMYKKYLRLYKKGLAPSLKVAERMRKRQFQKSLHHANARSLKCLFRLAANKTWAKVKDLRKLGKKHLYCLAT

SEQ ID NO: 5032 - protein, 20 aa, Artificial Sequence
  Computer-generated peptide variant
KWRYLKKYWKWLRHLGQKAL

SEQ ID NO: 5033 - protein, 31 aa, Artificial Sequence
  Computer-generated peptide variant
LYKLFSKLFRKMRKLRVEALAFRRKMACDKM

SEQ ID NO: 5034 - protein, 42 aa, Artificial Sequence
  Computer-generated peptide variant
KFKLWRRYLKKLSKKMLSLHMKKAHLRYHWKCLIRYETMALR

SEQ ID NO: 5035 - protein, 55 aa, Artificial Sequence
  Computer-generated peptide variant
LWRYLRKLMKFLKNANKKKDLCMAKKIAHCHHKCGTNLWGLKRALKRRLKLCVWD

SEQ ID NO: 5036 - protein, 50 aa, Artificial Sequence
  Computer-generated peptide variant
RIRYYCRLLKLWKKAARAISCRNWRQCRNRHGKRHVAKAWAAANWAADKR

SEQ ID NO: 5037 - protein, 40 aa, Artificial Sequence
  Computer-generated peptide variant
LIRFMKKWYRRYRKRRALKCLRARLLMVITSPWDAKAATF

SEQ ID NO: 5038 - protein, 60 aa, Artificial Sequence
  Computer-generated peptide variant
FYRFFKKYMKRIKRFKLCLFALLRDLRRSIARLARFAIARVKYGALAKTKWKSKQWLRLW

SEQ ID NO: 5039 - protein, 46 aa, Artificial Sequence
  Computer-generated peptide variant
FFRLIRKIFKRLNKPTRKRKCLSATTYPRAYAKKHALAVTLLRAIL

SEQ ID NO: 5040 - protein, 32 aa, Artificial Sequence
  Computer-generated peptide variant
YLRLYKKWWKIMPRHLDGAVAAKAWKYPLKKR

SEQ ID NO: 5041 - protein, 83 aa, Artificial Sequence
  Computer-generated peptide variant
KIKWLCRILKKMKTRFRELFELFQALAHMLDKAHKLASNRGTPICKKRSIRQMLKGLSLLLRAADQLWRRIWVLLHKRDKKAA

SEQ ID NO: 5042 - protein, 40 aa, Artificial Sequence
  Computer-generated peptide variant
KLKLLKKFLRFYQQLAAKAWKKQERLKASNVLARAHRDQR

SEQ ID NO: 5043 - protein, 20 aa, Artificial Sequence
  Computer-generated peptide variant
LIRLLNKWYKKFKCVLAKKS

SEQ ID NO: 5044 - protein, 56 aa, Artificial Sequence
  Computer-generated peptide variant
LYRLFHKLFKRLTKLKRDLNKAQRLFETLWNAAAIHDKAKLKYKAWKAIAVFMIDS

SEQ ID NO: 5045 - protein, 71 aa, Artificial Sequence
  Computer-generated peptide variant
IYRLYRRFYKLLKHLPRAKAAQARMALPKLVRAPSQEKSPATKFWCKASATLERQHAKRLSSPRLKLCIKA

SEQ ID NO: 5046 - protein, 43 aa, Artificial Sequence
  Computer-generated peptide variant
LIRYMRKLLKYLPCCKGRGDLNRSKFLFAMTLKCRAKLAGWRK

SEQ ID NO: 5047 - protein, 48 aa, Artificial Sequence
  Computer-generated peptide variant
YYRLYQKLWRRLRKAHRELEWKYTRHAKPAALAERKNPRAKCLAAGNW

SEQ ID NO: 5048 - protein, 64 aa, Artificial Sequence
  Computer-generated peptide variant
LFRLFCKFLRKFKTRADLRKKQKAAVKRHCPLAKARAAFLVIDDRRWRLIYRLRKTLTGARLLR

SEQ ID NO: 5049 - protein, 23 aa, Artificial Sequence
  Computer-generated peptide variant
LMRLLKRYMRLIRRNSPAARRDM

SEQ ID NO: 5050 - protein, 36 aa, Artificial Sequence
  Computer-generated peptide variant
RLKLYSRLLRYLPKKAPPLRKQLYRISRCHSMYRLG

SEQ ID NO: 5051 - protein, 58 aa, Artificial Sequence
  Computer-generated peptide variant
RFRLLKRFLKYLCQYARKLTRWYYKNWDWKLKALCVKRLCVFANKSAAQLKKLWYTQA

SEQ ID NO: 5052 - protein, 28 aa, Artificial Sequence
  Computer-generated peptide variant
WFKILRRLLRRFKCKAPIPNLLKLRMAA

SEQ ID NO: 5053 - protein, 25 aa, Artificial Sequence
  Computer-generated peptide variant
LIRLWHKLFRRLKCANVPRTAKVLM

SEQ ID NO: 5054 - protein, 69 aa, Artificial Sequence
  Computer-generated peptide variant
LIRIWKRLWKKYQHHAAINKLRAKRRRSWLVRLFKYLLVALKKLRLEVAKRTLKERHIDLSLLLFTTYH

SEQ ID NO: 5055 - protein, 34 aa, Artificial Sequence
  Computer-generated peptide variant
FLRWLKRIFRKLKQICGMALRKARQRTCNPLEAK

SEQ ID NO: 5056 - protein, 60 aa, Artificial Sequence
  Computer-generated peptide variant
KFRMFHRLMRMFKQKKRMLKLLGQIKQVNRVVRALAVTEERKAFLDRRAVAVLRQRAKAR

SEQ ID NO: 5057 - protein, 80 aa, Artificial Sequence
  Computer-generated peptide variant
KWKIMKRIMKKIPSLAATNAAAFKCLSLLYRAKYWALARLVGQRPLRPATYYLLPWLHEKDRDRLWLPAHLRKKHLATAR

SEQ ID NO: 5058 - protein, 20 aa, Artificial Sequence
  Computer-generated peptide variant
LYRLLHRILKKWKKYHARST

SEQ ID NO: 5059 - protein, 20 aa, Artificial Sequence
  Computer-generated peptide variant
RLKYYRRLFKFLQRAPCALL

SEQ ID NO: 5060 - protein, 22 aa, Artificial Sequence
  Computer-generated peptide variant
RLKFYKRILKKLKSAAGDFAFL

SEQ ID NO: 5061 - protein, 21 aa, Artificial Sequence
  Computer-generated peptide variant
LWKYLSRIYKKLKKKTARLPA

SEQ ID NO: 5062 - protein, 40 aa, Artificial Sequence
  Computer-generated peptide variant
LWKLWRKLMRKFPHQCAYDRKAHAAGKWAKAKAQRNVAHM

SEQ ID NO: 5063 - protein, 24 aa, Artificial Sequence
  Computer-generated peptide variant
LLRFLRKFYKFLKKQTVMALRTKM

SEQ ID NO: 5064 - protein, 29 aa, Artificial Sequence
  Computer-generated peptide variant
FFKMLRRMLKRWTKQAFARRVAALRLKAH

SEQ ID NO: 5065 - protein, 63 aa, Artificial Sequence
  Computer-generated peptide variant
LFKFIRRIYRRFRRLWLLRYMGGYCVTAAPALRRRTAGLCRRRRDRMARPKKRDCLCLPDACA

SEQ ID NO: 5066 - protein, 24 aa, Artificial Sequence
  Computer-generated peptide variant
KWKMFHKLLRLLTRKWHAKLNHAN

SEQ ID NO: 5067 - protein, 28 aa, Artificial Sequence
  Computer-generated peptide variant
MLRYFNKFYKLMRRAARCRLLRLTYSQK

SEQ ID NO: 5068 - protein, 48 aa, Artificial Sequence
  Computer-generated peptide variant
RFRFLRRLMKWFCRTLNNKRGNLLRQKPKAFALCAKLLKRQFPAAREK

SEQ ID NO: 5069 - protein, 20 aa, Artificial Sequence
  Computer-generated peptide variant
KFKFWPRLYKKWCKAAATFA

SEQ ID NO: 5070 - protein, 53 aa, Artificial Sequence
  Computer-generated peptide variant
ILRMINKLIRLWRRMSLARDFRLNARVLVAACNAKILGAAHILLQGKKGKLAK

SEQ ID NO: 5071 - protein, 62 aa, Artificial Sequence
  Computer-generated peptide variant
WIKWIKKFLKKMKKNKALLGKRRKLLAVNILRDKAAALVRRYAAASHLCQKAKYRWDPQLRV

SEQ ID NO: 5072 - protein, 44 aa, Artificial Sequence
  Computer-generated peptide variant
KLKLMKRFFRKFSRLKQKIPRAEDLALNMLFLFDAQALKRTLWT

SEQ ID NO: 5073 - protein, 95 aa, Artificial Sequence
  Computer-generated peptide variant
KFKFWKKLYKKLKRMLPWLPAAGHNEKVRLDHPFSFKLLLKARETIEDRGKKLMLWTKLYRASRYAPALCKRYRLGRCRKYTAATQAFSKAKLAL

SEQ ID NO: 5074 - protein, 49 aa, Artificial Sequence
  Computer-generated peptide variant
KLRWYKKMFRLLTPARHYKLLALLEAYMAAHLSKKRSNRCYGLKCNLKR

SEQ ID NO: 5075 - protein, 38 aa, Artificial Sequence
  Computer-generated peptide variant
LLKFYKRLFKKIRPKTVLLQALYLDCALMHRRAKDATC

SEQ ID NO: 5076 - protein, 29 aa, Artificial Sequence
  Computer-generated peptide variant
ILRWYTRYLRWWRKKHAATMLKKKELHCL

SEQ ID NO: 5077 - protein, 83 aa, Artificial Sequence
  Computer-generated peptide variant
LLRIFKKLYRKLNKCRCYSAAILILKIKALKRRFLRHKLLGEIAVRKCEKAPCVVHKRVWNLFDCESVEKKAYRAEAPLRLKR

SEQ ID NO: 5078 - protein, 20 aa, Artificial Sequence
  Computer-generated peptide variant
RLKMMKKLFRFLNRMGLLQR

SEQ ID NO: 5079 - protein, 49 aa, Artificial Sequence
  Computer-generated peptide variant
RFKMMQKLIKMYPKATWGRVKSKRALRLPADADKKPLMAQPKAARKKLQ

SEQ ID NO: 5080 - protein, 36 aa, Artificial Sequence
  Computer-generated peptide variant
LIRFLHRFLRRMPKKTLGKLKSLKSMTKKNLILGEL

SEQ ID NO: 5081 - protein, 27 aa, Artificial Sequence
  Computer-generated peptide variant
LLKWMRKLMRLLTKNFCPLCARYRQKG

SEQ ID NO: 5082 - protein, 35 aa, Artificial Sequence
  Computer-generated peptide variant
KMRWYKRMWKRIRRALLGAPKRLALALPMRENAIQ

SEQ ID NO: 5083 - protein, 34 aa, Artificial Sequence
  Computer-generated peptide variant
FFKYLKKLLRKMKCQLAKLKHAWGGKRTLRQPFV

SEQ ID NO: 5084 - protein, 56 aa, Artificial Sequence
  Computer-generated peptide variant
KLRLMRRLIKYLRRDAGKLMIKAHRKGWLAIRADWKCLWKLCVDRWAQRKMQYHAR

SEQ ID NO: 5085 - protein, 27 aa, Artificial Sequence
  Computer-generated peptide variant
LYRLIKRIIRRLNSYLRALCIKVKASN

SEQ ID NO: 5086 - protein, 40 aa, Artificial Sequence
  Computer-generated peptide variant
RYKWFCRLWKYIRKRLNAFSLLALRLRQPGLVSAFGQLRA

SEQ ID NO: 5087 - protein, 49 aa, Artificial Sequence
  Computer-generated peptide variant
IMKLLSRWFKLLPSRPQLWGLEKHRILRLKELRRKLAKLARREKNSRDI

SEQ ID NO: 5088 - protein, 35 aa, Artificial Sequence
  Computer-generated peptide variant
KLKLLQRFLKKWKHYTDLLLSHLLYKKPQKRRSGW

SEQ ID NO: 5089 - protein, 52 aa, Artificial Sequence
  Computer-generated peptide variant
MFKWFKKLLRKYQRLTLKNKSAAAKYNLFRRRRCKRCLTRSACAMWMQKISL

SEQ ID NO: 5090 - protein, 33 aa, Artificial Sequence
  Computer-generated peptide variant
LMKWLRKYLKLLSRMSAKANSRKILVKKELNKL

SEQ ID NO: 5091 - protein, 34 aa, Artificial Sequence
  Computer-generated peptide variant
MMRYYRKWIKLIPPLRMKKANRLARAVALYQWAK

SEQ ID NO: 5092 - protein, 24 aa, Artificial Sequence
  Computer-generated peptide variant
LLKLYRKWMKKLHKKCASARFAII

SEQ ID NO: 5093 - protein, 47 aa, Artificial Sequence
  Computer-generated peptide variant
RLKFYTRMLRLLSRTRDTSFRNKGRAHRRAVLMQIRLRRWTAAKVMA

SEQ ID NO: 5094 - protein, 34 aa, Artificial Sequence
  Computer-generated peptide variant
KLKWFRRFLKIYRRTCLDFLYCPADKRKALLVQK

SEQ ID NO: 5095 - protein, 85 aa, Artificial Sequence
  Computer-generated peptide variant
FLRLLKKFLKKFSCNAAEANRKPNLRMHPAWYRRCAALRGKWAMRAAEYGNSRDWAAGLFKRKRLILRKEELKIRIALIAKEMCV

SEQ ID NO: 5096 - protein, 29 aa, Artificial Sequence
  Computer-generated peptide variant
FMRYLHRFWKKLQRLRRLKRQFPNANLEA

SEQ ID NO: 5097 - protein, 75 aa, Artificial Sequence
  Computer-generated peptide variant
RMRWLSRFLKMWPQLILKKRRRIFYGATMVMARLKKLIKKHKCWRAAVRLKARAPPLIKHAARKGAKQVGMIAWK

SEQ ID NO: 5098 - protein, 21 aa, Artificial Sequence
  Computer-generated peptide variant
KLRFFKRYFKLLPRKQMWLCA

SEQ ID NO: 5099 - protein, 31 aa, Artificial Sequence
  Computer-generated peptide variant
KYKYWSRLLRKLRHKKLIYLRHAEARANDYL

SEQ ID NO: 5100 - protein, 34 aa, Artificial Sequence
  Computer-generated peptide variant
RLKYLKRMFKLYRKRYPVDRLELPAASCLHKEAY

SEQ ID NO: 5101 - protein, 29 aa, Artificial Sequence
  Computer-generated peptide variant
RLKWFKRLMRLISNPLLAAIIRRRHNAPY

SEQ ID NO: 5102 - protein, 67 aa, Artificial Sequence
  Computer-generated peptide variant
KLRLWKKLLRKYRKRNTRYAWSLLKASEAAVLRLPPYWYQRCRKPLVGKQKAKSEAHRHAARDEWGR

SEQ ID NO: 5103 - protein, 74 aa, Artificial Sequence
  Computer-generated peptide variant
KLRFLPKFFKLWKKLWAKRNLALATGFWVASKQNKKRQRLEAAKLKDDHKKAQLGKIKNKSNEMLLRSKLPKTR

SEQ ID NO: 5104 - protein, 40 aa, Artificial Sequence
  Computer-generated peptide variant
RMKLWRRIWKKYRSAKAARHRAQAKMLVCPLLQKKPLYVC

SEQ ID NO: 5105 - protein, 23 aa, Artificial Sequence
  Computer-generated peptide variant
RFKFMTRLIKYIKRLLKLLYKAH

SEQ ID NO: 5106 - protein, 38 aa, Artificial Sequence
  Computer-generated peptide variant
KLRLLHKLLRKFCCKDAAQLKARMPDKLIAMVTWLLRC

SEQ ID NO: 5107 - protein, 37 aa, Artificial Sequence
  Computer-generated peptide variant
MIRFYKKLLRLYKRAAFRIFKLAIKKVQRMALTLDPF

SEQ ID NO: 5108 - protein, 39 aa, Artificial Sequence
  Computer-generated peptide variant
FFKIMHKLLRRLRRARPNKRKLAHPAALCAQIFFFDCKA

SEQ ID NO: 5109 - protein, 69 aa, Artificial Sequence
  Computer-generated peptide variant
KIRWIQKLFRRLRSLLRAAQTRSLFKYRFDLRPTSERRCNLLNAKMLGKQAAEFAKLAERAFGPAEGLA

SEQ ID NO: 5110 - protein, 51 aa, Artificial Sequence
  Computer-generated peptide variant
RLKLISKMLRYWRQVLAKKFKKLTLKLRDLIQRVAYLQRDSLLKNLRVAMT

SEQ ID NO: 5111 - protein, 41 aa, Artificial Sequence
  Computer-generated peptide variant
YMRLLQKMMKFFKKPRVLAADDRLKSPAATALSKNYTLAKR

SEQ ID NO: 5112 - protein, 32 aa, Artificial Sequence
  Computer-generated peptide variant
MLRLMRKLLRKYRKLKPICTAHKLCLVANKRR

SEQ ID NO: 5113 - protein, 62 aa, Artificial Sequence
  Computer-generated peptide variant
MYRFYKKILRKYRNAIWKKAYAAFRAAKDPMRRRKEAEPLPISLNLKKRRACHKNAAELAYR

SEQ ID NO: 5114 - protein, 33 aa, Artificial Sequence
  Computer-generated peptide variant
LLRYFHRYIKKLKSALVRRANRRNKLPAIVRKL

SEQ ID NO: 5115 - protein, 28 aa, Artificial Sequence
  Computer-generated peptide variant
ILRYLRRWLRKLTKIPKDNKAGAAIKFA

SEQ ID NO: 5116 - protein, 25 aa, Artificial Sequence
  Computer-generated peptide variant
KLRYLTKLLRMLKKKMLYSLVKVSR

SEQ ID NO: 5117 - protein, 68 aa, Artificial Sequence
  Computer-generated peptide variant
RWKWLKRMYKKLRNRAPLEPTTVLKKSRLPRADRAALLRQRTARGKDSPAWLMSSFFLRKRAKPFWFL

SEQ ID NO: 5118 - protein, 93 aa, Artificial Sequence
  Computer-generated peptide variant
KFKIFKKWLKKIKKLHALRLRAVTRRLAALFECARKAAVKDLAHTFKQWAISLPMCSKAKWYLGKPLLYEKAMMLAFTRVRLARLNIELFDDR

SEQ ID NO: 5119 - protein, 43 aa, Artificial Sequence
  Computer-generated peptide variant
IMRFFKKWFKKFRQALRWRAHAKRCLVLLKASRQTATHLKKGA

SEQ ID NO: 5120 - protein, 39 aa, Artificial Sequence
  Computer-generated peptide variant
IIKYLRKMMRRLRRLKLLFKRKTKAELSLCHLPRAWATK

SEQ ID NO: 5121 - protein, 51 aa, Artificial Sequence
  Computer-generated peptide variant
KFRLWTRYLKYLTRLKAAMLALSAKICKAAWKRRVRRAARTRLRKYWKNKA

SEQ ID NO: 5122 - protein, 69 aa, Artificial Sequence
  Computer-generated peptide variant
RIRIIKRFLKKWRKLRAHSCPMSCGWACALRLKRRAWDTFKNLWFLRDLTKALRVKLRRAIWWGALAAS

SEQ ID NO: 5123 - protein, 35 aa, Artificial Sequence
  Computer-generated peptide variant
ILRFLRKWLKRFTCHFRAKLLRKALLGAKRRIDQA

SEQ ID NO: 5124 - protein, 40 aa, Artificial Sequence
  Computer-generated peptide variant
RIRWMNRLLKRIRRAQCFVKAAYWRYLLKRVWKAMAWSKC

SEQ ID NO: 5125 - protein, 85 aa, Artificial Sequence
  Computer-generated peptide variant
KLKLMKKLLKRIKRNFRRKLAQASLHALEHWIDLLKPRRLSDLDPYAISTKAKIARMKAQYYTGKCAVTAARWAKTPLMLLRFFC

SEQ ID NO: 5126 - protein, 20 aa, Artificial Sequence
  Computer-generated peptide variant
YLKMLTKLFRRFKTARYPRA

SEQ ID NO: 5127 - protein, 47 aa, Artificial Sequence
  Computer-generated peptide variant
KFKLWRKFYKLIRSKHHALLDRIKMKDLSMKNVGFIAARAEKLLKTA

SEQ ID NO: 5128 - protein, 28 aa, Artificial Sequence
  Computer-generated peptide variant
RFKLLKKWFKRLQCVKTRLASAAVNKAK

SEQ ID NO: 5129 - protein, 62 aa, Artificial Sequence
  Computer-generated peptide variant
KLRLYKKYIRKMQRKQYTRARAPKAKRLLSKSYVISPGRALALPQKDLYKLWLAKAESDLAC

SEQ ID NO: 5130 - protein, 52 aa, Artificial Sequence
  Computer-generated peptide variant
RIKLMHRWFKKLKRKYCLVEKKLDYAAVARIACKLVRIAAADEKLLYIAATM

SEQ ID NO: 5131 - protein, 21 aa, Artificial Sequence
  Computer-generated peptide variant
LLRIYNKIFKKLRCLKMHVLR

SEQ ID NO: 5132 - protein, 29 aa, Artificial Sequence
  Computer-generated peptide variant
KFRMLCRWWKLLRPLITRRRLRVLAAMKA

SEQ ID NO: 5133 - protein, 49 aa, Artificial Sequence
  Computer-generated peptide variant
FFKMFKRLLKRFKKLLRMLCLAKENAHGKGEYANPFKKAKHLLCCRNLY

SEQ ID NO: 5134 - protein, 70 aa, Artificial Sequence
  Computer-generated peptide variant
MLKIYKRLLRLYTKKKHTATKLKRRANKQRAKTKMNEANNCAKREHARPANRLLVAITLKMAKNQFRKIK

SEQ ID NO: 5135 - protein, 50 aa, Artificial Sequence
  Computer-generated peptide variant
RYRLITRLYKRYRPRGSFTLVHKKRKAPQRFAPFEAKKALSAHGKGARAL

SEQ ID NO: 5136 - protein, 30 aa, Artificial Sequence
  Computer-generated peptide variant
RFKWLKRFYRKLRQQIKVLALIKPAKWAFW

SEQ ID NO: 5137 - protein, 26 aa, Artificial Sequence
  Computer-generated peptide variant
RFRFLCRLIKLMRNLLYKPLLRPKNV

SEQ ID NO: 5138 - protein, 47 aa, Artificial Sequence
  Computer-generated peptide variant
RFKYLRRLFRKLKKFIWKGDFLLTKWWAFLHAKVRAKPRHSREAAFY

SEQ ID NO: 5139 - protein, 82 aa, Artificial Sequence
  Computer-generated peptide variant
LMRLIKKWYKYMRCLLLPKLLAYAKPLNAKMALTRMRKKRVRAMLDMHAVARMQLAWKDEALDALNLVYKRRGAVRLEEMFY

SEQ ID NO: 5140 - protein, 44 aa, Artificial Sequence
  Computer-generated peptide variant
KWKWLRKLWKYFRKLNQLKLLWLANYARCPQKYRLKKMLKWNVL

SEQ ID NO: 5141 - protein, 55 aa, Artificial Sequence
  Computer-generated peptide variant
LLKILTKMFKRLKKHKTNRALRLIKIMVKALNKAKLKAYPYLKLVRIKEIRHRHG

SEQ ID NO: 5142 - protein, 60 aa, Artificial Sequence
  Computer-generated peptide variant
RFRMYKRILKLLRRPKFPLIIMCFWNRDWRPALNLAKCESERRRYIILAALKKLFKAAQK

SEQ ID NO: 5143 - protein, 29 aa, Artificial Sequence
  Computer-generated peptide variant
RLKWLCKFYRLLPRARKLLRGWEYGTAHN

SEQ ID NO: 5144 - protein, 31 aa, Artificial Sequence
  Computer-generated peptide variant
RLRWWCRLWRRMKKAAFAFKGQLKLSTELAN

SEQ ID NO: 5145 - protein, 38 aa, Artificial Sequence
  Computer-generated peptide variant
RLRLFHRIYRKLKRGIQDAWRLRLQEMLALKKQKKLYL

SEQ ID NO: 5146 - protein, 27 aa, Artificial Sequence
  Computer-generated peptide variant
KLKFLNRIWRMLCCLAAPLEVGKRYKK

SEQ ID NO: 5147 - protein, 23 aa, Artificial Sequence
  Computer-generated peptide variant
KWKFIQRFFRRYTKAYDKLLLLL

SEQ ID NO: 5148 - protein, 24 aa, Artificial Sequence
  Computer-generated peptide variant
YIKLMRKFMKLLKKIIALTRYAKY

SEQ ID NO: 5149 - protein, 24 aa, Artificial Sequence
  Computer-generated peptide variant
KMRYFSKWLRWIKKSAALAYKPLK

SEQ ID NO: 5150 - protein, 39 aa, Artificial Sequence
  Computer-generated peptide variant
KMRMFKKIFRFWTNLAACACRLAIARLCCLLEGELRKRL

SEQ ID NO: 5151 - protein, 44 aa, Artificial Sequence
  Computer-generated peptide variant
RLRMLHRLWRKFRRTDRMWRRAYHKQRLDFDLLALQSAARKDIH

SEQ ID NO: 5152 - protein, 57 aa, Artificial Sequence
  Computer-generated peptide variant
RFKFLKRMLKRFKKAACKHYPIKKLRTRNLPCPLMTHAGSRLLQLKRRLTAQRLQIH

SEQ ID NO: 5153 - protein, 22 aa, Artificial Sequence
  Computer-generated peptide variant
KMRMLRRWIKLLNKAKVALFQG

SEQ ID NO: 5154 - protein, 25 aa, Artificial Sequence
  Computer-generated peptide variant
WMKLFKKMLRLMTKIIQATTLRKKL

SEQ ID NO: 5155 - protein, 50 aa, Artificial Sequence
  Computer-generated peptide variant
RLRWMRRYLKLIRSILRAAAARAYANAPWQLYRFLARLWWGHKNANRLRA

SEQ ID NO: 5156 - protein, 86 aa, Artificial Sequence
  Computer-generated peptide variant
FMKFLRKWLKFMKRASQVHCLKKLLNARLTFMHKPRKRAVLRRSARPGCEKCAMRCTVKARRLDLFRLCQAHAARQICLKIQKKRL

SEQ ID NO: 5157 - protein, 24 aa, Artificial Sequence
  Computer-generated peptide variant
LFKFMRRLLRRWPKLKRLPLEPDV

SEQ ID NO: 5158 - protein, 34 aa, Artificial Sequence
  Computer-generated peptide variant
KLRILRKIMRKWHSLRATGQGTFAKALAPKLKDR

SEQ ID NO: 5159 - protein, 40 aa, Artificial Sequence
  Computer-generated peptide variant
KWKLMKRMLRYLQNKLLALHFVHARPARHRHQGHKAYKAK

SEQ ID NO: 5160 - protein, 83 aa, Artificial Sequence
  Computer-generated peptide variant
RFKLLSKLYRKYHHKKADHLALLFRKRGCAQLRYAKQRLRARKIKQIAYKAWALWAESGRRMQLKDLTLLFAMARGALWMRIR

SEQ ID NO: 5161 - protein, 48 aa, Artificial Sequence
  Computer-generated peptide variant
WFRLLHRFYKKLKRAEKRDLYLLKKCLFKLKQAIRTKKNALCADKRCL

SEQ ID NO: 5162 - protein, 70 aa, Artificial Sequence
  Computer-generated peptide variant
RLRLIRKFFRMFTRVPADHHSKANALQKRHLKAYYAALAIKLLKVHRKGKRWLAFDRVPNAKNLGWRLKL

SEQ ID NO: 5163 - protein, 79 aa, Artificial Sequence
  Computer-generated peptide variant
RYRLLKRFWRKLRPIARHNDLHLATWLLLKKDRHAFIQYLLSKRMHRRKKLVISKRRINEKRLFASRSLLDDARWDASR

SEQ ID NO: 5164 - protein, 23 aa, Artificial Sequence
  Computer-generated peptide variant
MFKIFRKWLRRLQRANLPLNLPR

SEQ ID NO: 5165 - protein, 39 aa, Artificial Sequence
  Computer-generated peptide variant
FFKFFRRLMRRMRPFLLKCLVASTEAAAFERWLKRARYA

SEQ ID NO: 5166 - protein, 33 aa, Artificial Sequence
  Computer-generated peptide variant
KMRIMRKIIKLFRRAKLCHHCKFKNAELALLNL

SEQ ID NO: 5167 - protein, 30 aa, Artificial Sequence
  Computer-generated peptide variant
KLKIIHKMYKRIRPLPHKAYALLRRMRQML

SEQ ID NO: 5168 - protein, 65 aa, Artificial Sequence
  Computer-generated peptide variant
RFRMWKKFLKKFNPMDAGLRCIALSLKFGSLKFVLKIKRLWSRKHARLDRRCKRKALAFAVRGLL

SEQ ID NO: 5169 - protein, 34 aa, Artificial Sequence
  Computer-generated peptide variant
RFKLWKRIFRRIRKLASANTKKMALGCLLLTRTG

SEQ ID NO: 5170 - protein, 27 aa, Artificial Sequence
  Computer-generated peptide variant
LLRFFRRFIKKIHRKPHQYKAALLLAR

SEQ ID NO: 5171 - protein, 20 aa, Artificial Sequence
  Computer-generated peptide variant
KFKLLCKLWRLWSSKKKAWH

SEQ ID NO: 5172 - protein, 45 aa, Artificial Sequence
  Computer-generated peptide variant
KYKYYPRLYKRLCRIKLRQLAAELLLLMLYGERKRSMLKTVMTDR

SEQ ID NO: 5173 - protein, 21 aa, Artificial Sequence
  Computer-generated peptide variant
FYKYLRRLFRLIRRMKLALTR

SEQ ID NO: 5174 - protein, 58 aa, Artificial Sequence
  Computer-generated peptide variant
KLRLFKKMIRKLHRKAVARFDKKCYRKAAKLPALLTGWAVHWMEKQRAKIRLPPCSCT

SEQ ID NO: 5175 - protein, 26 aa, Artificial Sequence
  Computer-generated peptide variant
YFKLFRKLYKKMRRLAWGLKMREGLA

SEQ ID NO: 5176 - protein, 75 aa, Artificial Sequence
  Computer-generated peptide variant
RFRLYRKLLKRFRRKFRYLWLTGGILEYKLILNARNLVKACKAYTPSKRRAADRLLAPQWLAIKMKARMILSSPI

SEQ ID NO: 5177 - protein, 33 aa, Artificial Sequence
  Computer-generated peptide variant
KWKMLCRFLRFYTRAADDLLGRNQARARFAAGK

SEQ ID NO: 5178 - protein, 51 aa, Artificial Sequence
  Computer-generated peptide variant
RFKFIKRIWRRWRSKKLGGALNKSTLNKRKMFALLLSRCKLCRAMVRHALV

SEQ ID NO: 5179 - protein, 37 aa, Artificial Sequence
  Computer-generated peptide variant
KLRWWHKLLKKFRRDLSFWRPMLFLKTKSALEERFRL

SEQ ID NO: 5180 - protein, 30 aa, Artificial Sequence
  Computer-generated peptide variant
KLRLWRKLLRLYKKMKRALKWMQLLHAKEG

SEQ ID NO: 5181 - protein, 25 aa, Artificial Sequence
  Computer-generated peptide variant
RLKWFRRILRRIQCQAKTLATEKSL

SEQ ID NO: 5182 - protein, 25 aa, Artificial Sequence
  Computer-generated peptide variant
RFKYFKRIFRLLQHYKNNAAKAKLL

SEQ ID NO: 5183 - protein, 47 aa, Artificial Sequence
  Computer-generated peptide variant
LYRLIRKLLKRISKNVLQRVDVKAAKVRVNLAKMQALAFAGNPKENA

SEQ ID NO: 5184 - protein, 42 aa, Artificial Sequence
  Computer-generated peptide variant
WIKIMPRLLRRLKRLDHMPLLLLCRHRKKASRRLLCKHKKYT

SEQ ID NO: 5185 - protein, 23 aa, Artificial Sequence
  Computer-generated peptide variant
LLRIIRRYYKLFKKSLLLLKLAK

SEQ ID NO: 5186 - protein, 36 aa, Artificial Sequence
  Computer-generated peptide variant
KIRMIKKFLRLWKQWCLKTLRALFLSTLAEARKLHD

SEQ ID NO: 5187 - protein, 81 aa, Artificial Sequence
  Computer-generated peptide variant
KLKLFKRIWKLLKKATDMKFQRSNFFKRVADLRDLFALLYRAKAQICQARWWKKPRRASTCRSKTQNRKLLAAALEYNRWK

SEQ ID NO: 5188 - protein, 46 aa, Artificial Sequence
  Computer-generated peptide variant
ILKWLCRFLKLFNQDLNVCGRARARLAFTRLLKLAKKRKQLDACRW

SEQ ID NO: 5189 - protein, 64 aa, Artificial Sequence
  Computer-generated peptide variant
LYKLLPKLLRKWKKTDKIAKKQERAVRSAELKRNIWSLKALLAHWKFRHKLLGLFDFELHAEWS

SEQ ID NO: 5190 - protein, 70 aa, Artificial Sequence
  Computer-generated peptide variant
FLKYITKFFRMLQNKRLRVLALDAMKAMPRKPKRSVLYRNAKKPNRDERLLADWLCRRLKINRALQKAPL

SEQ ID NO: 5191 - protein, 23 aa, Artificial Sequence
  Computer-generated peptide variant
LYRIYHRYLKRFKHLAYRRTQAL

SEQ ID NO: 5192 - protein, 26 aa, Artificial Sequence
  Computer-generated peptide variant
RLKFFNKWFKKYKRLYKNKALPLAAH

SEQ ID NO: 5193 - protein, 33 aa, Artificial Sequence
  Computer-generated peptide variant
KIKMLSRWLKRLRKMAILRCKLARALLLHRNLR

SEQ ID NO: 5194 - protein, 40 aa, Artificial Sequence
  Computer-generated peptide variant
LFKLFRKFIKKLRRRPSAILFKLDLGLAGLSAVKKVMDAS

SEQ ID NO: 5195 - protein, 100 aa, Artificial Sequence
  Computer-generated peptide variant
LLKLFKKYWKWMKKKMPPACILGARDAILKHRLKKTRAKRASNKRHYLTQMKHKERKGARAKQFQCAAKCARAWWRDLVRLQNRRAKMPQHLCMGALKGK

SEQ ID NO: 5196 - protein, 25 aa, Artificial Sequence
  Computer-generated peptide variant
RLRFYTRLLRRWKQLVLSAKRWMGM

SEQ ID NO: 5197 - protein, 54 aa, Artificial Sequence
  Computer-generated peptide variant
KLRYIHKLFKLWRTRRAALAAAASAKMQAPGQLRVPIQTKQRATTMRLQDKARP

SEQ ID NO: 5198 - protein, 71 aa, Artificial Sequence
  Computer-generated peptide variant
LFRFLTKMFKLIKRKRDIKNLYSALWMRALYLLIKDLFARNRLKLLQKGARANAEAPGMKPATQHAAKETA

SEQ ID NO: 5199 - protein, 78 aa, Artificial Sequence
  Computer-generated peptide variant
YFKIFKKLWRKYRKHKHLILAGIVRLLQKMQLKGLCKFRAKLVNLLSPLCKYRRWRRAVACGLKMPDFAIPAALLYKA

SEQ ID NO: 5200 - protein, 28 aa, Artificial Sequence
  Computer-generated peptide variant
RLKLYRKMFKLYRKEKKGRMALAPLHGA

SEQ ID NO: 5201 - protein, 81 aa, Artificial Sequence
  Computer-generated peptide variant
RMRWLKKMIRFLHRQMKLAAPLLALYHSARNACDAFRHRNFLQGYQIKYFNKGKMLALIDRLRLAAAALRAAGAMKERKQA

SEQ ID NO: 5202 - protein, 49 aa, Artificial Sequence
  Computer-generated peptide variant
KIRFYNRWLRWFRKAWIMAHTRLKLADSKWCWAAWCWKKDRRLRLFALK

SEQ ID NO: 5203 - protein, 29 aa, Artificial Sequence
  Computer-generated peptide variant
RFKLFQKMMRILNKFLYRPAHLKRRLANQ

SEQ ID NO: 5204 - protein, 43 aa, Artificial Sequence
  Computer-generated peptide variant
LYRMWSRIIKRLRKLMKAFCAAKRYSKTIQAARQDRRALYHKF

SEQ ID NO: 5205 - protein, 25 aa, Artificial Sequence
  Computer-generated peptide variant
ILKLLRKLFRKLSCLLRDKKMCHAA

SEQ ID NO: 5206 - protein, 93 aa, Artificial Sequence
  Computer-generated peptide variant
LLRLIKRLFKKFNRGAKKTLMYQRAHHRARSMLKVNAILQWRKRSNCDATKAAMEKFLNKLFLEKMVERLRKKRSRATVGRMLTLLYKKRKGH

SEQ ID NO: 5207 - protein, 38 aa, Artificial Sequence
  Computer-generated peptide variant
KIKLLKKFLKFIHNAKLREKKRLQLAWDALFCLKEAVQ

SEQ ID NO: 5208 - protein, 63 aa, Artificial Sequence
  Computer-generated peptide variant
FLKILKRMMRLLQPLKARRKHIERWKARKTCCLKLDAPYLACLLRWEPIYRRYIARAKRMPPN

SEQ ID NO: 5209 - protein, 28 aa, Artificial Sequence
  Computer-generated peptide variant
LWRLYCRLIKKLRPRGQAKAFCRHLLAV

SEQ ID NO: 5210 - protein, 36 aa, Artificial Sequence
  Computer-generated peptide variant
FLRLMPKFWRLIRNVLHAKLKSVMRKAKRPKKLALA

SEQ ID NO: 5211 - protein, 79 aa, Artificial Sequence
  Computer-generated peptide variant
KLRFIKRWLRWIKRLLGKVRTLNGLANTARRRLKYFVRTRLKKRLENQLAGKAAPFDSLNSAAKDRATRWLNALVLLSW

SEQ ID NO: 5212 - protein, 42 aa, Artificial Sequence
  Computer-generated peptide variant
RLKYLCRWWKKLRQAVRKAKLFKKNKTYPKLEHDQLAENLLA

SEQ ID NO: 5213 - protein, 55 aa, Artificial Sequence
  Computer-generated peptide variant
KLKFYRRLLRKFQSRAVKKLGAIFIKIKGKKVRAPVKANYASLLAASQCGRMKAL

SEQ ID NO: 5214 - protein, 25 aa, Artificial Sequence
  Computer-generated peptide variant
LLKWFCRFYRKLTPTITAALKMAKL

SEQ ID NO: 5215 - protein, 56 aa, Artificial Sequence
  Computer-generated peptide variant
FLRFLKKLWKRFCKLAATKLMGSALHAKNLTLLKTSKFERPVYAADLLQAVSDHKK

SEQ ID NO: 5216 - protein, 43 aa, Artificial Sequence
  Computer-generated peptide variant
KWRWFQRWLRKIRRDKKEGNRACRLAPKFLKAQALPHGLLAFF

SEQ ID NO: 5217 - protein, 43 aa, Artificial Sequence
  Computer-generated peptide variant
FLKLWTRIWRIYKKFLKGKRQKEMRLLIAKMLAPLHRWLYLLA

SEQ ID NO: 5218 - protein, 49 aa, Artificial Sequence
  Computer-generated peptide variant
RFKYLRRLFKKWHKRYKFYWLRHVKLYPLKRASAALDKLHLVQLAADQK

SEQ ID NO: 5219 - protein, 65 aa, Artificial Sequence
  Computer-generated peptide variant
MIKFLHKLIKKLHKKRPAWQKKERLEKRCNLAAVKRLKAQWVLFKDLRPLERDLLTQRAGFKWAT

SEQ ID NO: 5220 - protein, 89 aa, Artificial Sequence
  Computer-generated peptide variant
KFKWIPRIFKLFRHRKRQLSALFRKAALFKRLPPEMRRLLYMRRKLKHADSLAGAAKLDRRARPKCRFPLLSNLFADLACLKGRRALQQ

SEQ ID NO: 5221 - protein, 59 aa, Artificial Sequence
  Computer-generated peptide variant
KLRLYRKFFKRYRNCRKDSRKKVWTVHLTARRAHAPPTRRVLENAAAYLRPPRLAADAV

SEQ ID NO: 5222 - protein, 20 aa, Artificial Sequence
  Computer-generated peptide variant
FLKLLTRIWRKLTRRFQNEA

SEQ ID NO: 5223 - protein, 33 aa, Artificial Sequence
  Computer-generated peptide variant
WMKFMRKLYRRYSRMRCKLLNLLFRNTRALKAA

SEQ ID NO: 5224 - protein, 64 aa, Artificial Sequence
  Computer-generated peptide variant
IFKYLRRFIKRWRPLLIGWKVDRALALDEKMLGDGALLEILALEFKLKARKMAATRRKLKAVKW

SEQ ID NO: 5225 - protein, 20 aa, Artificial Sequence
  Computer-generated peptide variant
KYRMMPKLIKKLQQKARCLA

SEQ ID NO: 5226 - protein, 28 aa, Artificial Sequence
  Computer-generated peptide variant
LMRILKRWIRKLNKRKVDAALRKALLLR

SEQ ID NO: 5227 - protein, 67 aa, Artificial Sequence
  Computer-generated peptide variant
RFRFLQKLLRRFRRTAAWEISLCDRLKAIHYWLANGKARRLAKCRCSIKIAEKAATFLFFCRNIRAR

SEQ ID NO: 5228 - protein, 67 aa, Artificial Sequence
  Computer-generated peptide variant
RYKFWSKWYRKIRRLVKDVRAPHARLSVKPGWEAGALRLKLQAHLPLVRAAKRLHFAGVKAEKALAK

SEQ ID NO: 5229 - protein, 30 aa, Artificial Sequence
  Computer-generated peptide variant
MMKFLKKLFRKLQKLTLNKLRNMWHRDKSL

SEQ ID NO: 5230 - protein, 27 aa, Artificial Sequence
  Computer-generated peptide variant
KLRLYQRMFKFYKKCKQRLTLLAALGQ

SEQ ID NO: 5231 - protein, 45 aa, Artificial Sequence
  Computer-generated peptide variant
KWRFFKKLFKYLRTKVAYLYMLRDAASPRTIAAKNHRAKDPLRRR

SEQ ID NO: 5232 - protein, 36 aa, Artificial Sequence
  Computer-generated peptide variant
RMKLLKRFFRMIPTGYAMKTALQGRKARRRLCANPA

SEQ ID NO: 5233 - protein, 49 aa, Artificial Sequence
  Computer-generated peptide variant
LIRFMKKWYRRLRKRAVKAAAESNRRLNRCKLINNEELAQAKKKPLAKA

SEQ ID NO: 5234 - protein, 44 aa, Artificial Sequence
  Computer-generated peptide variant
KFRFLCRMLKWLRRRAANLRKHRSKLTLLRDEANLAYKKKKHQT

SEQ ID NO: 5235 - protein, 56 aa, Artificial Sequence
  Computer-generated peptide variant
RLRMWKRLFRLLKKRKLALKPAKHMCLCGAKLLRLRHKDGLQYKKFKRTLCKFLSG

SEQ ID NO: 5236 - protein, 20 aa, Artificial Sequence
  Computer-generated peptide variant
YLKYIHKLFRLFKQPLAANR

SEQ ID NO: 5237 - protein, 60 aa, Artificial Sequence
  Computer-generated peptide variant
WWKLLKKMWKWMRRLERRCGAFICAAAFKRLWKDRAWLRVKTPFDLCAASCPKKKLCAIK

SEQ ID NO: 5238 - protein, 68 aa, Artificial Sequence
  Computer-generated peptide variant
RFRLFRRFLRLMKKKTRLNKGANKPHKFLRGRICYDLRMNLATDRHENRAWLLWPMAKLQKAKNKKLP

SEQ ID NO: 5239 - protein, 30 aa, Artificial Sequence
  Computer-generated peptide variant
KLRLFNRMMRRLRCLALKRLHRHWPFLKLK

SEQ ID NO: 5240 - protein, 28 aa, Artificial Sequence
  Computer-generated peptide variant
WLKMLNRLLRLYKRYNGAVAALCKHRVI

SEQ ID NO: 5241 - protein, 30 aa, Artificial Sequence
  Computer-generated peptide variant
MLKLLRKLFKLYRKADSKMMKKYAVMHALR

SEQ ID NO: 5242 - protein, 86 aa, Artificial Sequence
  Computer-generated peptide variant
KIRWYRRMLRWIRTLRDTWKDERRFWRQRAKHRKRAFRAKPTWCAMPRWRANCRLASSKLLIPCHLNLSRAKLAALIILIMKLKLK

SEQ ID NO: 5243 - protein, 33 aa, Artificial Sequence
  Computer-generated peptide variant
KLKYLRRFFKKFKRAKNAALRALGITLHKRILQ

SEQ ID NO: 5244 - protein, 32 aa, Artificial Sequence
  Computer-generated peptide variant
LFRYLSKIFRKLTRAAKMAGLFFIRRHKRGFA

SEQ ID NO: 5245 - protein, 28 aa, Artificial Sequence
  Computer-generated peptide variant
ILKLYKKFLKLLKCKSCHLLGILHRRRY

SEQ ID NO: 5246 - protein, 43 aa, Artificial Sequence
  Computer-generated peptide variant
RLRLYKKLMRRLCRLQIFATAARRKLESRGNLYNANLSMGLET

SEQ ID NO: 5247 - protein, 34 aa, Artificial Sequence
  Computer-generated peptide variant
RLKFYKKIYRKLRSQALLALNARRYIKPDCDEVK

SEQ ID NO: 5248 - protein, 52 aa, Artificial Sequence
  Computer-generated peptide variant
KLRMLRRLLKMWKKKDLAHLSWQLLQMWAHAACKKEDKTYKGPKQWPHAKRL

SEQ ID NO: 5249 - protein, 60 aa, Artificial Sequence
  Computer-generated peptide variant
FWRYFRKYFKKLKCQHRMRKLIPNTALAARRAKSLYKKEIEANAKSMLDGYKKAVKAALN

SEQ ID NO: 5250 - protein, 78 aa, Artificial Sequence
  Computer-generated peptide variant
MLKMFTRLFRMLNRASRYRAKGSRLLMCAVRHSQRSYCALGIWTATLRRARLHIKHMARKTQALKILRWWWRKKAARA

SEQ ID NO: 5251 - protein, 31 aa, Artificial Sequence
  Computer-generated peptide variant
RLKILKRMFRRLRTTAFKKYNKPAKSAALQS

SEQ ID NO: 5252 - protein, 64 aa, Artificial Sequence
  Computer-generated peptide variant
MMRLWCKFLKKFPSCSADKHAARFHKKVQTRQLKVAAYLAWQRAKALTLKLDKDAARGRRGARG

SEQ ID NO: 5253 - protein, 40 aa, Artificial Sequence
  Computer-generated peptide variant
FFKLFNRFMRKMCRLKTWAKLAALALRQALKPKKARDLLG

SEQ ID NO: 5254 - protein, 25 aa, Artificial Sequence
  Computer-generated peptide variant
FLKLYRKLFKRLCRLKKKLDRLHLM

SEQ ID NO: 5255 - protein, 53 aa, Artificial Sequence
  Computer-generated peptide variant
YLKIFQKMWKMIKSLKLNAKYLKNQLKNAKAMPRENRYGRLLERARQKLACKL

SEQ ID NO: 5256 - protein, 76 aa, Artificial Sequence
  Computer-generated peptide variant
RFRYLNRWLKFMRKKLAPLLMQIKRVLAKKRLSRGHNRDARKAWGDDDAALRKAMRMAPHAALAMQAACAIRQVRF

SEQ ID NO: 5257 - protein, 51 aa, Artificial Sequence
  Computer-generated peptide variant
KFRLWNKIFKFLRRGAMLFLAKFFRVLKLKLGSCKAASLCLMESALLKGHK

SEQ ID NO: 5258 - protein, 22 aa, Artificial Sequence
  Computer-generated peptide variant
FFKMLRKMLKRLKCASKTAAMT

SEQ ID NO: 5259 - protein, 61 aa, Artificial Sequence
  Computer-generated peptide variant
YIKLYPKFLRKFRSDLQCRLLKLIALDKFHKKWRLRWFKAKKARWKIRKYYFLRPLWAAMK

SEQ ID NO: 5260 - protein, 24 aa, Artificial Sequence
  Computer-generated peptide variant
FWRLLPKLLRWLRSRRDRWHLAAG

SEQ ID NO: 5261 - protein, 47 aa, Artificial Sequence
  Computer-generated peptide variant
WWRLFSKLLRKLHTKKMCSHNKCLCGWWAKRRAVPRQLALGARKNAR

SEQ ID NO: 5262 - protein, 35 aa, Artificial Sequence
  Computer-generated peptide variant
FLRFFQKFLRILRKRKRKARAVENMVNFARALLGK

SEQ ID NO: 5263 - protein, 38 aa, Artificial Sequence
  Computer-generated peptide variant
MFRFLRKLFKRLKQIRRKFWRDHLAAHLFIKLYNRQAL

SEQ ID NO: 5264 - protein, 29 aa, Artificial Sequence
  Computer-generated peptide variant
RYRFLRRYLKKFRPQAHVIAAARLHRYAE

SEQ ID NO: 5265 - protein, 75 aa, Artificial Sequence
  Computer-generated peptide variant
IFRFLKKLFKRIQRAGKHWHKSSRRKAPTKARDQKVLRLALPKAKKFRDDALVKMALKDNRTALRDEIAIYRPWA

SEQ ID NO: 5266 - protein, 66 aa, Artificial Sequence
  Computer-generated peptide variant
RLKMMRKYLKRIKKARERCHRRICGWWRPHLAYIEAEANFKMDERRKKRCARMDMACPARALALAA

SEQ ID NO: 5267 - protein, 21 aa, Artificial Sequence
  Computer-generated peptide variant
KFKLLTKFLKMYRRLVRVAFE

SEQ ID NO: 5268 - protein, 58 aa, Artificial Sequence
  Computer-generated peptide variant
RIKLLKKLMRFMHSLKIAYLGRDVNKEFLIHAAKRAKMRSRKSAKMLQRKWRNAEFAT

SEQ ID NO: 5269 - protein, 38 aa, Artificial Sequence
  Computer-generated peptide variant
RLRLWRRYLRRYSHKYAWLLVYALIKGKRWELELATIE

SEQ ID NO: 5270 - protein, 23 aa, Artificial Sequence
  Computer-generated peptide variant
LLKLFKRFLRRFHKGGDLAYWKS

SEQ ID NO: 5271 - protein, 52 aa, Artificial Sequence
  Computer-generated peptide variant
KFRYFRKFLRRLRTKAKSKRRLLRKHRRNRVVGYYWDWLKLAIDLDWGALLA

SEQ ID NO: 5272 - protein, 47 aa, Artificial Sequence
  Computer-generated peptide variant
KLRLFKKLIRRFPPRVKRARAFLKVKRNTAYKFKRAFLLPADDLKAC

SEQ ID NO: 5273 - protein, 49 aa, Artificial Sequence
  Computer-generated peptide variant
YLKLICRYIKILRRSKRNALKRRTMEAPKLMLLKPSRNGMCKRRAAHAD

SEQ ID NO: 5274 - protein, 56 aa, Artificial Sequence
  Computer-generated peptide variant
RLRMLRKYFKKFKSLKLKRFGGKAKRAQKLADWADRRLYPVQAPTYLRVRWKILAG

SEQ ID NO: 5275 - protein, 33 aa, Artificial Sequence
  Computer-generated peptide variant
LLKFINRFLRKLPKDRLPNAYIRCETKKLALLA

SEQ ID NO: 5276 - protein, 31 aa, Artificial Sequence
  Computer-generated peptide variant
MLKFLRKMYRKMRNAASHCKRGAFRARHAPA

SEQ ID NO: 5277 - protein, 27 aa, Artificial Sequence
  Computer-generated peptide variant
LYKLMTRLIRRFRKTGLKLDVRAAKTC

SEQ ID NO: 5278 - protein, 61 aa, Artificial Sequence
  Computer-generated peptide variant
KLKMFRKFFKLFKRNLAGGRNADGESTNLRLLKSVMWWRRQKRTQLRRAIAKKKALHHFAA

SEQ ID NO: 5279 - protein, 67 aa, Artificial Sequence
  Computer-generated peptide variant
RLKIWKKWLKLFKKVYSEPKMRDLWKAVADSDAEVRVKAMTRPFAGKFFAKLLARKRRLWLKAWRCL

SEQ ID NO: 5280 - protein, 74 aa, Artificial Sequence
  Computer-generated peptide variant
FLRWLRRFYKWWCRRHLFLVKCAVLQRGVAAALARRFPMYLAVCKARRLKERLLRKHLAWIRALLEPHRRILPA

SEQ ID NO: 5281 - protein, 50 aa, Artificial Sequence
  Computer-generated peptide variant
LWKLMHRLLRKFRRADAAMLGSRKKNTANKAALYRKKKQELKFGRKQKAL

SEQ ID NO: 5282 - protein, 60 aa, Artificial Sequence
  Computer-generated peptide variant
RMKLLQRFFRYLTTTYKLAAAKHCLKFKKMMKWQRRTAKNKALCASRKDWRRSILTLACS

SEQ ID NO: 5283 - protein, 42 aa, Artificial Sequence
  Computer-generated peptide variant
KFKLWKKMLKKWKNRRFCNAEAAAIKHCLLKEALKFRKCAWP

SEQ ID NO: 5284 - protein, 22 aa, Artificial Sequence
  Computer-generated peptide variant
KMKYLRKWFRLLCRHGKAHLAQ

SEQ ID NO: 5285 - protein, 48 aa, Artificial Sequence
  Computer-generated peptide variant
KLKYLRRYLKFFNKCALKRLLPAGSTQWPLRAKVDEKLAKWSKYYHLL

SEQ ID NO: 5286 - protein, 23 aa, Artificial Sequence
  Computer-generated peptide variant
WFKFMKKIFRRLNKRALIALRAC

SEQ ID NO: 5287 - protein, 42 aa, Artificial Sequence
  Computer-generated peptide variant
KLRIFKRILRFLNNFTQISRAKKVLLKPALVKDWKARKLREA

SEQ ID NO: 5288 - protein, 26 aa, Artificial Sequence
  Computer-generated peptide variant
RLKYFPRLLRIYCKTHRRKLAWLPLW

SEQ ID NO: 5289 - protein, 41 aa, Artificial Sequence
  Computer-generated peptide variant
IWKLLQRYLKKLKRRGLVLTMTRRDRALMRLKLLFWGLKKA

SEQ ID NO: 5290 - protein, 71 aa, Artificial Sequence
  Computer-generated peptide variant
LLKLLKKWIKKLQNDEVLRMWMWLFPAAKHMNWNGASAARKASLVAFFGRKKRANACLKRRAQLKWRLVRA

SEQ ID NO: 5291 - protein, 29 aa, Artificial Sequence
  Computer-generated peptide variant
RWRWLSRLWRRLRHNRRRLAAATKAMADR

SEQ ID NO: 5292 - protein, 50 aa, Artificial Sequence
  Computer-generated peptide variant
LWKLLTRILKLFRKRKRRVLKINLLLKLLRKPGAQLWKHCQRLAPHESAI

SEQ ID NO: 5293 - protein, 34 aa, Artificial Sequence
  Computer-generated peptide variant
RLKILPKFYRLYKKQLRGLSWRRATALSRAEWMK

SEQ ID NO: 5294 - protein, 56 aa, Artificial Sequence
  Computer-generated peptide variant
RLRFFQRYMKRYKTWRMRRVLRHPQHFARAAAGKAEWAALNRMKLGRKHMLNLAAK

SEQ ID NO: 5295 - protein, 31 aa, Artificial Sequence
  Computer-generated peptide variant
KIRLLRRLWKLLCTKCAAPLHALRYIIRGRC

SEQ ID NO: 5296 - protein, 30 aa, Artificial Sequence
  Computer-generated peptide variant
KWKMLCKMLKRLSKLKKPACADKEVTDKLQ

SEQ ID NO: 5297 - protein, 38 aa, Artificial Sequence
  Computer-generated peptide variant
RYRYLNRYLRFLKRTRVALNIFKATYAYTIKLRKRYML

SEQ ID NO: 5298 - protein, 43 aa, Artificial Sequence
  Computer-generated peptide variant
RLRLWRKMWKLFKCARLLAMWRRKQLMEYKERNAPRWCARETW

SEQ ID NO: 5299 - protein, 51 aa, Artificial Sequence
  Computer-generated peptide variant
LLKFLRRYFKKLQQIPKAIHRKGLPAVCDCLARADKEAPLRVKAVNKAAAG

SEQ ID NO: 5300 - protein, 65 aa, Artificial Sequence
  Computer-generated peptide variant
KLRWLNRLMKLMKKKFLKARFKFIRPRHFHFRFKVIKYAGVKAFCRAALLLLAWDRTYLFSLTKQ

SEQ ID NO: 5301 - protein, 22 aa, Artificial Sequence
  Computer-generated peptide variant
LLKILSRFIKKLRRAKLLRMDF

SEQ ID NO: 5302 - protein, 27 aa, Artificial Sequence
  Computer-generated peptide variant
LWRLISKMLRKLRNVTRMARQLFAAAY

SEQ ID NO: 5303 - protein, 67 aa, Artificial Sequence
  Computer-generated peptide variant
KFKWLRRLLKYLKPTARVYALPLALIKAHRLLALEANGCRMAKNNIILCRCMLMLWKRPPKDKRKDK

SEQ ID NO: 5304 - protein, 49 aa, Artificial Sequence
  Computer-generated peptide variant
FWRLICKLMRKLRKWLYAPHKAATKGKLKLNRAAFWRKRCQLKHRLCSR

SEQ ID NO: 5305 - protein, 25 aa, Artificial Sequence
  Computer-generated peptide variant
YLRFLQKWLKMLHRREYLRAKLLGK

SEQ ID NO: 5306 - protein, 97 aa, Artificial Sequence
  Computer-generated peptide variant
KIRLLKKLWRLLRKWTTLVCAYQWLSVVLCLAKRFQYRYKAWLLFCDGANIRLKERKLNETKKHPWKKWLVLKRTKMWRMLHARAKQKDQAKLKASK

SEQ ID NO: 5307 - protein, 55 aa, Artificial Sequence
  Computer-generated peptide variant
RLKYLCRWLKFWRKMSQLRNIVLKGLKLDSALMCRAALWSKRKACKTLLQLIGRA

SEQ ID NO: 5308 - protein, 25 aa, Artificial Sequence
  Computer-generated peptide variant
KMKLMCKWFKKLNSKLLAQFNLRCK

SEQ ID NO: 5309 - protein, 39 aa, Artificial Sequence
  Computer-generated peptide variant
KFRFLKRLWKRLKKLLQIRKYLEKMFFVATPAKQQLYTL

SEQ ID NO: 5310 - protein, 25 aa, Artificial Sequence
  Computer-generated peptide variant
LFKWLSRFYKRLKRTSMLLLTNLWR

SEQ ID NO: 5311 - protein, 20 aa, Artificial Sequence
  Computer-generated peptide variant
KLRIYKKLLKLYTTPHSAYA

SEQ ID NO: 5312 - protein, 58 aa, Artificial Sequence
  Computer-generated peptide variant
RMRLYHKYLKRLKTRNIKLAQKHYVRWKACYLARNLMAMRANGAIRGQLRLKYSSATA

SEQ ID NO: 5313 - protein, 71 aa, Artificial Sequence
  Computer-generated peptide variant
RLKLFRRIWKLFKRQMLTNQRKAAMLGIQTKARNDRAEAKPQANARRIAWPAIAQRAARFHARAKCKAWTC

SEQ ID NO: 5314 - protein, 32 aa, Artificial Sequence
  Computer-generated peptide variant
LLKFYRRLLRRMKKSQMKLHGAREHKAHKLLA

SEQ ID NO: 5315 - protein, 23 aa, Artificial Sequence
  Computer-generated peptide variant
FLKLMRKFLKLISRERQHASRML

SEQ ID NO: 5316 - protein, 45 aa, Artificial Sequence
  Computer-generated peptide variant
LYKMLKRWLRRLRRARTKHANLDWFGPKSTARFVRKARQALDILT

SEQ ID NO: 5317 - protein, 37 aa, Artificial Sequence
  Computer-generated peptide variant
KLKWLSRMIRKIRRNARGAAPSKKCLGMRIAAASLGR

SEQ ID NO: 5318 - protein, 41 aa, Artificial Sequence
  Computer-generated peptide variant
RLKYFPKFFRYLPKRLKLAEAEKWLAHDLRNELHKQAKMLK

SEQ ID NO: 5319 - protein, 89 aa, Artificial Sequence
  Computer-generated peptide variant
RLKLLKRIIRYFRKKWLKCLRKVCQQQFLALQKLSLKALTEFQIVQKLKAMKRAVVAEFIRRRARRVLLALRRYCASMDAPQQLEYRAD

SEQ ID NO: 5320 - protein, 20 aa, Artificial Sequence
  Computer-generated peptide variant
RMKLIKKLLRMLSCHFPEAR

SEQ ID NO: 5321 - protein, 79 aa, Artificial Sequence
  Computer-generated peptide variant
LFRMLKKMLRKLCQCHKYKTTTQLKAQRLAAKLVNGRRARKIKGKCILFRDTCSGAVVFTALLYRWLWKAVRKALRAAI

SEQ ID NO: 5322 - protein, 85 aa, Artificial Sequence
  Computer-generated peptide variant
KYKFFRRLFKKIKKKKLEHEAEEWIAKISAAGFKALELARMKPRRALMRLWRRKLKAAHQWALFLRYWLTPRKGLALRYGQRKAF

SEQ ID NO: 5323 - protein, 45 aa, Artificial Sequence
  Computer-generated peptide variant
WIKMLKKFLRKIKKLKLNCLLALNMARFMQKRRIRILSYPKDAWN

SEQ ID NO: 5324 - protein, 80 aa, Artificial Sequence
  Computer-generated peptide variant
RFRFFRKWFKRLKKLQWLCNLRHPDQILWRLKFAMKRAHKRGVLKKKNFLAREPQAKTWMQHKYALNRQKLVAAASRRLA

SEQ ID NO: 5325 - protein, 33 aa, Artificial Sequence
  Computer-generated peptide variant
FYRLITRLFKRLRRSKRLFRLARVRTLRAMEAD

SEQ ID NO: 5326 - protein, 29 aa, Artificial Sequence
  Computer-generated peptide variant
LFKYMKRMLKKFPSERELAYARIILKQRL

SEQ ID NO: 5327 - protein, 30 aa, Artificial Sequence
  Computer-generated peptide variant
KLKLFNRILRRLHRSRLRAFVRSLLLERPA

SEQ ID NO: 5328 - protein, 29 aa, Artificial Sequence
  Computer-generated peptide variant
ILRLLNKIFRRYRNKLKDMMRKYEQSAAA

SEQ ID NO: 5329 - protein, 43 aa, Artificial Sequence
  Computer-generated peptide variant
LLKWLNKFLKRLTRAGKAPERLDLTRANGKRRPPMGAQKRTVT

SEQ ID NO: 5330 - protein, 55 aa, Artificial Sequence
  Computer-generated peptide variant
RYRIIKKIIKRWNRAARKLMYGFALHKEKLLMLAISAETALKHRELLEYRLGKIL

SEQ ID NO: 5331 - protein, 69 aa, Artificial Sequence
  Computer-generated peptide variant
RIRLMQRMFRRLSCLVRLRRKNIKEQCRMLDRRAATRFLILRLQAGRSQDNNEAKRANNRELAKAACLA

SEQ ID NO: 5332 - protein, 32 aa, Artificial Sequence
  Computer-generated peptide variant
IFKFLPRLLRKLRKLAARRVKLAMLKTKQTRC

SEQ ID NO: 5333 - protein, 63 aa, Artificial Sequence
  Computer-generated peptide variant
RLRLYKKFYKLIKNRKSKRHACVDLELYRKKLAGNNERLRRYARLSGGAYGLLNGALQCLPAF

SEQ ID NO: 5334 - protein, 74 aa, Artificial Sequence
  Computer-generated peptide variant
RLRWLHRLFKMIRKQLLYCACLATGFCNRRLYLKRTCKVQGRWAALEWLKRLFKFKLATAMSKEPLNSARLFLL

SEQ ID NO: 5335 - protein, 42 aa, Artificial Sequence
  Computer-generated peptide variant
KWKLMTRWFRKWKRLHKRISAAKQHRLGFAALKRLKKTAFGL

SEQ ID NO: 5336 - protein, 87 aa, Artificial Sequence
  Computer-generated peptide variant
RLRFFKRIFKMLRSRTDRMRRYTDWRRIALNAWRLKGTWRRKLSFALPREAESAARKASLLLLVLPHANFMLDFIAYKKKKKKFMAK

SEQ ID NO: 5337 - protein, 69 aa, Artificial Sequence
  Computer-generated peptide variant
KLKFFPRMFRRYKRALSEPLTDRAGGEFAVRARKDLAAKKRDLCKKALYHQFRAATLRQLRDSAKQVFL

SEQ ID NO: 5338 - protein, 32 aa, Artificial Sequence
  Computer-generated peptide variant
YWKYIRKLMKMFRKQTRELKALLMLRSLMYLL

SEQ ID NO: 5339 - protein, 34 aa, Artificial Sequence
  Computer-generated peptide variant
RFRYLNRMWRKLRKMMKQAALCANTCLEVAPKAR

SEQ ID NO: 5340 - protein, 60 aa, Artificial Sequence
  Computer-generated peptide variant
RLRIWSRMLRMMRKKYLAAMLRLGMYINHPLPAAKKRALELARALFTHQELMQYTRLRMA

SEQ ID NO: 5341 - protein, 31 aa, Artificial Sequence
  Computer-generated peptide variant
KWRLLKRFWRMLHSKTKRWAKDMARKAMLWA

SEQ ID NO: 5342 - protein, 24 aa, Artificial Sequence
  Computer-generated peptide variant
LLRFFKKWFKLLKKLARNEWLEHK

SEQ ID NO: 5343 - protein, 37 aa, Artificial Sequence
  Computer-generated peptide variant
IFRLLKKYLKKFKKAAKTDAAACEHLNKVVKWRDQAG

SEQ ID NO: 5344 - protein, 21 aa, Artificial Sequence
  Computer-generated peptide variant
KLKLIRKFLRLITRINRVIEA

SEQ ID NO: 5345 - protein, 51 aa, Artificial Sequence
  Computer-generated peptide variant
RMRFMCRIFRLLRQARRAARKAMGLTRYRLARLADRYNILYIHKDEHKAKE

SEQ ID NO: 5346 - protein, 42 aa, Artificial Sequence
  Computer-generated peptide variant
KFKLYRRLFRIYQNKLAARLAALQKKCINRCRVIAKGLGERM

SEQ ID NO: 5347 - protein, 46 aa, Artificial Sequence
  Computer-generated peptide variant
KFRYLKRFWRLMRRLNHKRAGCEKDFAKRAACFARDKTLLLTLNKM

SEQ ID NO: 5348 - protein, 20 aa, Artificial Sequence
  Computer-generated peptide variant
RLRLMTKYLKWFCRRWFALW

SEQ ID NO: 5349 - protein, 32 aa, Artificial Sequence
  Computer-generated peptide variant
LMRWLHKLLKIFRRKEARGNKFIRSALELGAV

SEQ ID NO: 5350 - protein, 22 aa, Artificial Sequence
  Computer-generated peptide variant
RLKWMKRLWRYLHKLRLARWFL

SEQ ID NO: 5351 - protein, 36 aa, Artificial Sequence
  Computer-generated peptide variant
LFRLISKLLKRIKKKVFAPKEAVKKVPIHLLLKKLW

SEQ ID NO: 5352 - protein, 37 aa, Artificial Sequence
  Computer-generated peptide variant
MFRLFRRMWKRLRRKDKQAKGEKLLEHQLRLLTFSLA

SEQ ID NO: 5353 - protein, 40 aa, Artificial Sequence
  Computer-generated peptide variant
KYKFFKRILRRIHHLRKMAGCLLARSAAYKLAKHCRAARH

SEQ ID NO: 5354 - protein, 53 aa, Artificial Sequence
  Computer-generated peptide variant
RLKYFKKYLRKIRCAELSAKLLAQFLKRHEAILFSYKRAAQMATLTIERPARL

SEQ ID NO: 5355 - protein, 96 aa, Artificial Sequence
  Computer-generated peptide variant
KLKFLRKLFKYYHSAAVLAKKLLAEKTLTADAGGTRLTCRPRHSKWLLFTIPKKQFLSLKAKRPCAVNQALDKLLKPAPRLRPADHMRRFLSWKAR

SEQ ID NO: 5356 - protein, 41 aa, Artificial Sequence
  Computer-generated peptide variant
RFKLIKRWMKKLRHLLMRSLCKAKGRLRALGAAELKKSKQD

SEQ ID NO: 5357 - protein, 40 aa, Artificial Sequence
  Computer-generated peptide variant
FLKLLSRLYRRLSCRLRVHQIARLLKWHAAHKRNLAKDLG

SEQ ID NO: 5358 - protein, 38 aa, Artificial Sequence
  Computer-generated peptide variant
YWKFYRKFLRKFRTLLIAFRQVAAVGDAALLAYQRRHL

SEQ ID NO: 5359 - protein, 35 aa, Artificial Sequence
  Computer-generated peptide variant
LMKYLKRFLKKFKRLARRLYRMKAGAGHRAVDMHL

SEQ ID NO: 5360 - protein, 40 aa, Artificial Sequence
  Computer-generated peptide variant
KYRFLHRLMKYLQKNRRFKLKTKHTMALAYCRAAGGPYAK

SEQ ID NO: 5361 - protein, 32 aa, Artificial Sequence
  Computer-generated peptide variant
KLKLWKRILRMFKKADDLRTKQRTQPAAAETV

SEQ ID NO: 5362 - protein, 32 aa, Artificial Sequence
  Computer-generated peptide variant
KLRWLHKWFKRLPKKFRCLDLLLFVGRYTLTR

SEQ ID NO: 5363 - protein, 38 aa, Artificial Sequence
  Computer-generated peptide variant
IFKLFTRLLRRLCNKAYGLKPHRYTLPLRRCLRKGFYL

SEQ ID NO: 5364 - protein, 55 aa, Artificial Sequence
  Computer-generated peptide variant
KLRMYRKLLKKYKRAARRLAHLYHQDKWFAEHRLTLILKKALWYVDQFKSPRANA

SEQ ID NO: 5365 - protein, 91 aa, Artificial Sequence
  Computer-generated peptide variant
RYKLFNKFMRRWRQYLKIRVAAKNLRRRPKAKWLLTRFSFTVLANLALCHKTLPRRAVNKTKARKLHRRIRKLLRPPCRRLYHCVALNLII

SEQ ID NO: 5366 - protein, 51 aa, Artificial Sequence
  Computer-generated peptide variant
FIRYFHRLLRRYSQLVARGATFAAARMETLKLVTPREKLALKLRFWKKKWL

SEQ ID NO: 5367 - protein, 22 aa, Artificial Sequence
  Computer-generated peptide variant
RLKLLPRMLRKLPSDHHTRLLK

SEQ ID NO: 5368 - protein, 69 aa, Artificial Sequence
  Computer-generated peptide variant
RIKLMSRFIRRLRQGLTKDALTRKFRAEFLHRLKARVAAALVKAALLLLLDALTKCKCQIVNVEKHILG

SEQ ID NO: 5369 - protein, 50 aa, Artificial Sequence
  Computer-generated peptide variant
ILRMLQKLIKLYRRALILPSEAAFRRAHEASLFEHPANCKDKKLKIGAAR

SEQ ID NO: 5370 - protein, 29 aa, Artificial Sequence
  Computer-generated peptide variant
KMRLWRKYIRMMCSLKKLEKAFLKLCLLN

SEQ ID NO: 5371 - protein, 60 aa, Artificial Sequence
  Computer-generated peptide variant
YYKMYQRIFKRMHKLMLCKCLMQLLFEALPRKFKSRRKLWCLARRCKDSKADRKALTNLK

SEQ ID NO: 5372 - protein, 31 aa, Artificial Sequence
  Computer-generated peptide variant
KFKYIRRLLKYLSKKRAIKAKWAKALDAIPQ

SEQ ID NO: 5373 - protein, 74 aa, Artificial Sequence
  Computer-generated peptide variant
WWKIFKRLFKKFHREAARRLHRSLLLELMPQKLELTPQFPFARRRARGYMHARKLRWDASLDLLEPNRRAAKRT

SEQ ID NO: 5374 - protein, 31 aa, Artificial Sequence
  Computer-generated peptide variant
KYRLFRRYFRFLSTRAAKKHKYADALMRAFM

SEQ ID NO: 5375 - protein, 29 aa, Artificial Sequence
  Computer-generated peptide variant
IWKWMPRLLKLWKKARALRRKWQPAQTAA

SEQ ID NO: 5376 - protein, 45 aa, Artificial Sequence
  Computer-generated peptide variant
KFKLWKKLWKLLKSGLCLYLRWAALKCMRRQLGSLAQCRDPFRCV

SEQ ID NO: 5377 - protein, 52 aa, Artificial Sequence
  Computer-generated peptide variant
KLRLWRKMYKLLRCCKARPERRPSAQQCILAVELPLTKLASDAARRARMYLV

SEQ ID NO: 5378 - protein, 24 aa, Artificial Sequence
  Computer-generated peptide variant
RFRLWNKWLRLLPRYKLQRDLLLK

SEQ ID NO: 5379 - protein, 22 aa, Artificial Sequence
  Computer-generated peptide variant
LLKLMQKFWKKFRQALRKELLL

SEQ ID NO: 5380 - protein, 40 aa, Artificial Sequence
  Computer-generated peptide variant
MLKLYKRLYRKIKNPNLALLLAGNRWARSLLYKQGDVATY

SEQ ID NO: 5381 - protein, 38 aa, Artificial Sequence
  Computer-generated peptide variant
KYKFLRKLFKRFRRHIGLNLKLSWRNLFAARGQRFAQM

SEQ ID NO: 5382 - protein, 29 aa, Artificial Sequence
  Computer-generated peptide variant
LFKFYKKLIRMLSNLRKNFLVAELYKEKK

SEQ ID NO: 5383 - protein, 22 aa, Artificial Sequence
  Computer-generated peptide variant
KLKYLHRILKKLPNLRHTAGKV

SEQ ID NO: 5384 - protein, 29 aa, Artificial Sequence
  Computer-generated peptide variant
KLRLYTKILKRLKKIKKKLKDLFLLMYLV

SEQ ID NO: 5385 - protein, 61 aa, Artificial Sequence
  Computer-generated peptide variant
RFRLWRRFWRLFKRATIGKAAQHAAPNRSALKYEKRDYAKKPKAEAWLCKKLHKNFVAADH

SEQ ID NO: 5386 - protein, 20 aa, Artificial Sequence
  Computer-generated peptide variant
RLKLFSKLYRRLQKAAADVR

SEQ ID NO: 5387 - protein, 80 aa, Artificial Sequence
  Computer-generated peptide variant
LLKWFSRYFRRIKKVLKLTTWYRFKCDLRRPLRFLALRPRRNAVSARALFEAACRCYHLEAGARRKSNYFKLAFRASRYP

SEQ ID NO: 5388 - protein, 69 aa, Artificial Sequence
  Computer-generated peptide variant
KWKMFCRLFRRLKRDKAKVSQGQLKKRHHALLCRFRLHMCIHFCRIEYARIRLLRRAARLWHDKAEAVK

SEQ ID NO: 5389 - protein, 21 aa, Artificial Sequence
  Computer-generated peptide variant
YFRIFRRLLRIFHRAILAKRV

SEQ ID NO: 5390 - protein, 59 aa, Artificial Sequence
  Computer-generated peptide variant
KIRFLNKFIKKWRREAYNRKRLARSYAQSWLSQGTIAAFLAANADLERRRPVRDRRKAL

SEQ ID NO: 5391 - protein, 79 aa, Artificial Sequence
  Computer-generated peptide variant
KLRFMRKLIKLFKSKLKRKVSLSTVALLRCANLIRLHWRLARRRLMKSGIHLKCKMSKETPDLNRRMSWLARKLCLKHK

SEQ ID NO: 5392 - protein, 56 aa, Artificial Sequence
  Computer-generated peptide variant
FIRLWPRLLKRFRKMRPRLTRWRIGNRRLHRKAFFLARLQAIKLFGGARVILLWKH

SEQ ID NO: 5393 - protein, 35 aa, Artificial Sequence
  Computer-generated peptide variant
KMRLWKRLIKMFRPKRDLAVEARMAYAWKAPGKAR

SEQ ID NO: 5394 - protein, 21 aa, Artificial Sequence
  Computer-generated peptide variant
KFRLMRKWLKWIKKLEPGAAS

SEQ ID NO: 5395 - protein, 92 aa, Artificial Sequence
  Computer-generated peptide variant
RYKWFRKLYKKFRCLYKREATARAADSRLLAAFRREPQWDVIRRRNLDGLLTNAQGLKFKQGKRLLLGRQCRQRLDKDSLLEAAELAAVAQP

SEQ ID NO: 5396 - protein, 33 aa, Artificial Sequence
  Computer-generated peptide variant
KWKMYRKWWKLLRKHAPRFRARAGFAALMAAGK

SEQ ID NO: 5397 - protein, 24 aa, Artificial Sequence
  Computer-generated peptide variant
RLKLIQKLIKYMRKKAFELNDAQL

SEQ ID NO: 5398 - protein, 43 aa, Artificial Sequence
  Computer-generated peptide variant
RIRMFTKLMKLLRHRAKKLRKLAKWLYKVQSNGALAYRTRSSF

SEQ ID NO: 5399 - protein, 21 aa, Artificial Sequence
  Computer-generated peptide variant
YLKIFRKFLKRLRHMATLRDG

SEQ ID NO: 5400 - protein, 80 aa, Artificial Sequence
  Computer-generated peptide variant
YLRLWKKMMRLIRPAMLRELARKMCKKEHLWHPAGAHGLINTKLEWHLLASSWKAAAGSAGWYKRAARLKAAKEEAAMKH

SEQ ID NO: 5401 - protein, 52 aa, Artificial Sequence
  Computer-generated peptide variant
MLKMLRKMFKFFQRLARCGEAKHECFALEKKNNIRHRLKRNRARKNLFARLL

SEQ ID NO: 5402 - protein, 43 aa, Artificial Sequence
  Computer-generated peptide variant
RLRFLPRLYRKFSPARLKVKLNTRKTACDRFNHKRDMLMAMLL

SEQ ID NO: 5403 - protein, 34 aa, Artificial Sequence
  Computer-generated peptide variant
LMKLIHKLFRKLNPADKLTLGKMKRKNWRNLRAQ

SEQ ID NO: 5404 - protein, 27 aa, Artificial Sequence
  Computer-generated peptide variant
KYRWLTRLYRRFKRASALHAPKLLQIN

SEQ ID NO: 5405 - protein, 33 aa, Artificial Sequence
  Computer-generated peptide variant
LLRLYKKFMRLLKSRFLDNNIRWANDAAAMKKF

SEQ ID NO: 5406 - protein, 34 aa, Artificial Sequence
  Computer-generated peptide variant
RLKLWRKFFKKLNHDLLRCHDTQMAFRYLSAKKK

SEQ ID NO: 5407 - protein, 80 aa, Artificial Sequence
  Computer-generated peptide variant
KIRLFRKYMRRYKRDRAAIARGMDVEATLKKYAPSMLQALGLSILNFLCHARKEAEKYPLGTAARKAFNQAFANRLKAAK

SEQ ID NO: 5408 - protein, 57 aa, Artificial Sequence
  Computer-generated peptide variant
RWKLLRRIYKRWKTPRELVHAWLLWARKRAYLMKKLEMLPNRRIADKCRCQLKLAMV

SEQ ID NO: 5409 - protein, 26 aa, Artificial Sequence
  Computer-generated peptide variant
RLKLMTKFIKRFKQKALWLMLLKEEI

SEQ ID NO: 5410 - protein, 25 aa, Artificial Sequence
  Computer-generated peptide variant
RIKFYRRLLRRMRNLWMAALRRENL

SEQ ID NO: 5411 - protein, 34 aa, Artificial Sequence
  Computer-generated peptide variant
FMRLLHKYLRLLPKLAALQEFRKESKPKLKQPRY

SEQ ID NO: 5412 - protein, 23 aa, Artificial Sequence
  Computer-generated peptide variant
KIRLWPKLMRKLKRHAAADSENK

SEQ ID NO: 5413 - protein, 42 aa, Artificial Sequence
  Computer-generated peptide variant
RYKLFSKFLRRMRRMIIASEKIQRCANCKKWLLYKWLAAARK

SEQ ID NO: 5414 - protein, 78 aa, Artificial Sequence
  Computer-generated peptide variant
RMKLLCRFLKLLRTDAKPAAEATTRKRLARNRWGALQRKWRNPIRYIGALQKLKILKKGVRAQGLARARMKKKLVWRV

SEQ ID NO: 5415 - protein, 54 aa, Artificial Sequence
  Computer-generated peptide variant
YLKFFKKLIRKFTRPARLRHRLIRSSRAFRWALILLVLIFCGQCKALQAAAYRM

SEQ ID NO: 5416 - protein, 25 aa, Artificial Sequence
  Computer-generated peptide variant
KFKLFCRFLRRLRPRAKGSMAQDQA

SEQ ID NO: 5417 - protein, 79 aa, Artificial Sequence
  Computer-generated peptide variant
WWRILRRMWRKFRKYRGRNAARNPGRKGYKGMALLALARIPANHKVKQIARLEARWYAKAKPKIVFAKLALNDAALFRS

SEQ ID NO: 5418 - protein, 31 aa, Artificial Sequence
  Computer-generated peptide variant
YMRLLKKLWRKYCRLARGDCWEAVKKLDTLK

SEQ ID NO: 5419 - protein, 29 aa, Artificial Sequence
  Computer-generated peptide variant
KIKLINKLLKRFKTATPKLHAVPIAPRGL

SEQ ID NO: 5420 - protein, 42 aa, Artificial Sequence
  Computer-generated peptide variant
LIRLFNRFWKRMKRRLKWTGLRPRAGDFRTRLLCLKTYANAK

SEQ ID NO: 5421 - protein, 95 aa, Artificial Sequence
  Computer-generated peptide variant
KLKWLQKFLRRFRNLKRVMFKRPQADYDIKANITKAKIHAAAKRANCKKAARRFKTMYATARLKAWARLWKLARKMRFQDTLEKALAVTLQLQTQ

SEQ ID NO: 5422 - protein, 37 aa, Artificial Sequence
  Computer-generated peptide variant
KLKMLSRFWKLLRRLLVITLLQNRKLDVAVQRRRNSG

SEQ ID NO: 5423 - protein, 31 aa, Artificial Sequence
  Computer-generated peptide variant
RFKMFKKLMKKFTKCFLETKKPADALLWALR

SEQ ID NO: 5424 - protein, 37 aa, Artificial Sequence
  Computer-generated peptide variant
RFKLWNKLLRKLRHLNLVMKTAAFLRVWCLYLVRTKT

SEQ ID NO: 5425 - protein, 58 aa, Artificial Sequence
  Computer-generated peptide variant
RMKMLRRFLRKLRRKWREWLRLRRKVACGSDAKTAFDTIQRAWRGQLLVNAAFKARAS

SEQ ID NO: 5426 - protein, 39 aa, Artificial Sequence
  Computer-generated peptide variant
LLRIMHRWYKILKKRARKDRNLFKKAEDTSATIAFALGR

SEQ ID NO: 5427 - protein, 26 aa, Artificial Sequence
  Computer-generated peptide variant
MWRLLKKWLRKFRHKQQQLAPWLIKA

SEQ ID NO: 5428 - protein, 22 aa, Artificial Sequence
  Computer-generated peptide variant
YLKFLNRFFKKMQRMLARLLLY

SEQ ID NO: 5429 - protein, 74 aa, Artificial Sequence
  Computer-generated peptide variant
IYKLWSKLFKRMSCAVSQPCAERRFKKFNRAGTKLAYRLCLRHNYKARLDRALIWKARRLKNKRYARGAKKPIA

SEQ ID NO: 5430 - protein, 40 aa, Artificial Sequence
  Computer-generated peptide variant
FLRYFRRLIKKLQCRCLYALKLLMRCAYADKHKQWSKRKY

SEQ ID NO: 5431 - protein, 77 aa, Artificial Sequence
  Computer-generated peptide variant
RIRWMKRMLKYWPKAKLRLFALMAQMAKRLQAIDPLRGWATRARLKPTAGDCKRKFKAVCAAQLLQGAALRAVQDQN

SEQ ID NO: 5432 - protein, 22 aa, Artificial Sequence
  Computer-generated peptide variant
MMKLLKRFWKLMKTNMLNAKKL

SEQ ID NO: 5433 - protein, 56 aa, Artificial Sequence
  Computer-generated peptide variant
RMRLWRKFFKLLKKTTWHRIRNARAAYIRKAYMRTAAEMRLLTTLKKLARLLLTNH

SEQ ID NO: 5434 - protein, 61 aa, Artificial Sequence
  Computer-generated peptide variant
RYRYLHKLIRYIQKRNLEKLHAKLLLVKFKQQAWDLNYRRHFDVVELRKRHCRLKLDRAAL

SEQ ID NO: 5435 - protein, 67 aa, Artificial Sequence
  Computer-generated peptide variant
KMRILRKFFRRFTPTRKRATKWIIRRRLMPRSLAMVALATRKANATRIELPARYALEACDVAYLTAK

SEQ ID NO: 5436 - protein, 38 aa, Artificial Sequence
  Computer-generated peptide variant
FWRFLRKYLRFYRQALAWRCAASRQWLLLMYLKQNRFA

SEQ ID NO: 5437 - protein, 30 aa, Artificial Sequence
  Computer-generated peptide variant
LFKMIKKLFKYFNRRACHAKAMLRNLQGRA

SEQ ID NO: 5438 - protein, 28 aa, Artificial Sequence
  Computer-generated peptide variant
KWKMLRKLLRMLHQWSRLRVRLDAGAKL

SEQ ID NO: 5439 - protein, 45 aa, Artificial Sequence
  Computer-generated peptide variant
LIRFICRLIKLFRRARWLAKHKAEAKAGGKMIRARDRKLCVENSY

SEQ ID NO: 5440 - protein, 47 aa, Artificial Sequence
  Computer-generated peptide variant
WLKFLKKMLRLFRRRTHATAKLFRKHAEQHCLLKFNKVIRWAHRVMK

SEQ ID NO: 5441 - protein, 51 aa, Artificial Sequence
  Computer-generated peptide variant
WFKLLKKLMRKLNKLPTAPKTAAKMQLWLMNRKQQDGSFLLLIELRAELRA

SEQ ID NO: 5442 - protein, 50 aa, Artificial Sequence
  Computer-generated peptide variant
FLRILRKIIRRFKRHLMVAPRAKAINYHLRAASVRCRGCMAIAMRASARK

SEQ ID NO: 5443 - protein, 54 aa, Artificial Sequence
  Computer-generated peptide variant
FLRFYCKIIKKLTRMKAIIRAHRRALVRRAAAYRDLSRREILRLFKKARILRSA

SEQ ID NO: 5444 - protein, 35 aa, Artificial Sequence
  Computer-generated peptide variant
RLKIYHKYMRMLPTRERLALRARFIGKHLKAAYLR

SEQ ID NO: 5445 - protein, 26 aa, Artificial Sequence
  Computer-generated peptide variant
LIKFMTKIFKKLKKALPHKEDQRLLA

SEQ ID NO: 5446 - protein, 49 aa, Artificial Sequence
  Computer-generated peptide variant
KYRMFRRYWRRLRNLARRARQRPWVANGCGCLRVHAAKKAHRAFSLLCR

SEQ ID NO: 5447 - protein, 31 aa, Artificial Sequence
  Computer-generated peptide variant
RFRLLRKLLKLFRKKRRRAFICGLALPRSLS

SEQ ID NO: 5448 - protein, 37 aa, Artificial Sequence
  Computer-generated peptide variant
KLKWLRRMFKMLHSLSQRTGLTKAKAFATTKVRRDAK

SEQ ID NO: 5449 - protein, 60 aa, Artificial Sequence
  Computer-generated peptide variant
RYRLLSKIWRMLRRPMWRGDLFVKFNQRKLAKLAKRGQEAKHERKKKFYLPHAKLGCLLN

SEQ ID NO: 5450 - protein, 99 aa, Artificial Sequence
  Computer-generated peptide variant
FLRYYKRFMRKMKKGLRNSNQAMKQLVHLAKAYACKRWLALYRRMTRCDKKKHVRRLKLFYVIKLKLLCLPRLLQARAMRLCPMKLAFKVKPAAPKRHR

SEQ ID NO: 5451 - protein, 55 aa, Artificial Sequence
  Computer-generated peptide variant
MFRLLNKLIRRLQRRMATPIRGAVKKRMLLRCLIDLLRIAYRRAARLSDYNLKLA

SEQ ID NO: 5452 - protein, 36 aa, Artificial Sequence
  Computer-generated peptide variant
KLKIIKKIYRRLNPEAVLECKKFRSAAAAPAVRKYA

SEQ ID NO: 5453 - protein, 38 aa, Artificial Sequence
  Computer-generated peptide variant
MLRLLQRFIKRFSRAWRKRSESILTKLLYGREAKLMQR

SEQ ID NO: 5454 - protein, 26 aa, Artificial Sequence
  Computer-generated peptide variant
RMKLMKRFFKRFKPMDARLDLAASKL

SEQ ID NO: 5455 - protein, 34 aa, Artificial Sequence
  Computer-generated peptide variant
FFRIIRRYMRLFNTRKAYQAMRLWRLRLKRMPLL

SEQ ID NO: 5456 - protein, 22 aa, Artificial Sequence
  Computer-generated peptide variant
LMKLFTKLLRFLTHAQKPRAHK

SEQ ID NO: 5457 - protein, 21 aa, Artificial Sequence
  Computer-generated peptide variant
RIRLLRKWYKILQKLGSHLAI

SEQ ID NO: 5458 - protein, 36 aa, Artificial Sequence
  Computer-generated peptide variant
ILKFFRKWIRRLRCEQALGDPKITLKLAANMRNRAR

SEQ ID NO: 5459 - protein, 80 aa, Artificial Sequence
  Computer-generated peptide variant
LLKLMRRLFRRFRQAVVKRKDNNHCLAARAMLKRLRRMPSCVKPNWAQPLGRKMRKAFAKRLPNRLLPTKIKISLYLNLW

SEQ ID NO: 5460 - protein, 81 aa, Artificial Sequence
  Computer-generated peptide variant
MLKLLKKFLRKFCTAHGFNKLLLALYKNKAVADALLIRIKRQKRCYRPACRAHFYVICKLAKEGCIEDAARAEDLRLLQKK

SEQ ID NO: 5461 - protein, 76 aa, Artificial Sequence
  Computer-generated peptide variant
RLRYMKKLYRMFKKAEFADLALNRRYRKALHGILRENWLKILARLYLHAIRLARRNRTDLKKRCKAEHPLAGLPLT

SEQ ID NO: 5462 - protein, 29 aa, Artificial Sequence
  Computer-generated peptide variant
LIRILRRLFRYLKKNLHVYKARDLVLGIG

SEQ ID NO: 5463 - protein, 77 aa, Artificial Sequence
  Computer-generated peptide variant
ILKYFPRFFKKFKRKVRTAMMICARKAQPNFTDLLKRLKRAMRARKVTALREWRLEALLAHRNPFNALKRYHADAAC

SEQ ID NO: 5464 - protein, 28 aa, Artificial Sequence
  Computer-generated peptide variant
KWKLLRRWFRKLPTEYKMLVMLRLAKSS

SEQ ID NO: 5465 - protein, 37 aa, Artificial Sequence
  Computer-generated peptide variant
RLKWIKRMLRLFKRFDCARAISPKKLWIGRHLCRYLA

SEQ ID NO: 5466 - protein, 45 aa, Artificial Sequence
  Computer-generated peptide variant
YLRLLQKWIRRLQKRASRADKARWLLRKLDNSMLGDALAAKYGYQ

SEQ ID NO: 5467 - protein, 48 aa, Artificial Sequence
  Computer-generated peptide variant
RWKIINKIFKWFQKADYKAAKVLARARKLDACRVSAKWARARMLTKRP

SEQ ID NO: 5468 - protein, 62 aa, Artificial Sequence
  Computer-generated peptide variant
RFKLFRKLLRYYKPAFPGLDAAYNFKKAQMAKEACRPQGLKVLFAAKRVWGDTAARKRLIAA

SEQ ID NO: 5469 - protein, 49 aa, Artificial Sequence
  Computer-generated peptide variant
LIRFLPKWLRRFSPLRRFEANFKLAAWMKRKNCTLCKLLIKHAYLARKK

SEQ ID NO: 5470 - protein, 74 aa, Artificial Sequence
  Computer-generated peptide variant
IYKYLPRLFRKIQPRDAMSQTYVKKRALASCLARLCFARLRLAGRTLALMMEKKLLLRLDKRRICQQNWQRKRL

SEQ ID NO: 5471 - protein, 21 aa, Artificial Sequence
  Computer-generated peptide variant
KLRFIRRYYKWWRRIEALAAF

SEQ ID NO: 5472 - protein, 46 aa, Artificial Sequence
  Computer-generated peptide variant
LLRLMSRFLRWYNKMRLAGRDMKPKARDHKARDRLMKCAELVRRVL

SEQ ID NO: 5473 - protein, 29 aa, Artificial Sequence
  Computer-generated peptide variant
LLKLWNKLWKFLRHVRTCRELTACPKRER

SEQ ID NO: 5474 - protein, 28 aa, Artificial Sequence
  Computer-generated peptide variant
RYRMMRKMLKILRRMNLKLANAARKLGQ

SEQ ID NO: 5475 - protein, 27 aa, Artificial Sequence
  Computer-generated peptide variant
KMRFLHKMIKRFKQALLRQHNTAAGAR

SEQ ID NO: 5476 - protein, 36 aa, Artificial Sequence
  Computer-generated peptide variant
MMKMLRRLFKRFKKARALTAVMRLRCSLAEYKHWRA

SEQ ID NO: 5477 - protein, 22 aa, Artificial Sequence
  Computer-generated peptide variant
RLKFLSKLFKFWKNLLPALRDS

SEQ ID NO: 5478 - protein, 52 aa, Artificial Sequence
  Computer-generated peptide variant
RLRMLKRLIRMLCCWGRKLHCWFQQAAYRLLFVTKKANLHKCRACSRAARLL

SEQ ID NO: 5479 - protein, 29 aa, Artificial Sequence
  Computer-generated peptide variant
LLKFMQRLLRKLKRILALDGLNTRGVTKL

SEQ ID NO: 5480 - protein, 65 aa, Artificial Sequence
  Computer-generated peptide variant
RLRLICRIMKWFKQIKSKRLALVRFWARNDLRLLMGLDPGMLKRKDVEKVRAVAALIVAKELKLD

SEQ ID NO: 5481 - protein, 38 aa, Artificial Sequence
  Computer-generated peptide variant
RLKLLRRLYRLLRKKNQFDTRHAMDIRHFVGLVNAALL

SEQ ID NO: 5482 - protein, 24 aa, Artificial Sequence
  Computer-generated peptide variant
RMKMLNKFLRKYQSARLGARSALK

SEQ ID NO: 5483 - protein, 60 aa, Artificial Sequence
  Computer-generated peptide variant
KWRILSKMFKKLRRCAAMRGNLKVRRYFRALKKKQMHWASHALKAYQWPKAYKFRALAKA

SEQ ID NO: 5484 - protein, 22 aa, Artificial Sequence
  Computer-generated peptide variant
KLKLFHKLLKKWKPLDHLFRKC

SEQ ID NO: 5485 - protein, 25 aa, Artificial Sequence
  Computer-generated peptide variant
LWRLLQKIFKKITKRNAIRNDLLLK

SEQ ID NO: 5486 - protein, 42 aa, Artificial Sequence
  Computer-generated peptide variant
KMRMLKRLLKRLRNARRLGKLKAEKLKRLCEVHETQPADHGW

SEQ ID NO: 5487 - protein, 21 aa, Artificial Sequence
  Computer-generated peptide variant
MLRLLSRFLKKYRRELLAVQF

SEQ ID NO: 5488 - protein, 76 aa, Artificial Sequence
  Computer-generated peptide variant
ILRLFRRFLKRLKKGKREALRNQKSMFCAFQEKTKTKRFKKLKLYAARICGKHNAILARSDARMIERILTLTAFKQ

SEQ ID NO: 5489 - protein, 39 aa, Artificial Sequence
  Computer-generated peptide variant
FLKFMKKWLKKFRPKQLEDIKGADKLAFLAGRVYLVLAK

SEQ ID NO: 5490 - protein, 95 aa, Artificial Sequence
  Computer-generated peptide variant
RFKLICKLMRYLSRIMPKLAAWLCWQLYARLQKRKACSRKLKQRNQKRHMCLLVERLQKFLPILGLARLAWKKLTAMWKRFLTTKGLAGQLELFA

SEQ ID NO: 5491 - protein, 45 aa, Artificial Sequence
  Computer-generated peptide variant
LYKFMPRLYRMYQRLLAAQNQAKRTAQARAHLRKICKNAPNKDAR

SEQ ID NO: 5492 - protein, 80 aa, Artificial Sequence
  Computer-generated peptide variant
LMKLLKKFYKRFRRDRFAQNRLKRMKAHLIFFLAAQANFKMADRKAAYMARADMRKTPIVAAHDLHRELKFALNKYKMTN

SEQ ID NO: 5493 - protein, 21 aa, Artificial Sequence
  Computer-generated peptide variant
RLRLFHRLLRLIHKQLPAIKQ

SEQ ID NO: 5494 - protein, 91 aa, Artificial Sequence
  Computer-generated peptide variant
KIKLLTRYFKKISHKKQVKCLPDFILAAYKLMADECRARPKRVRHKALGGKGIFAQKKRAIRHSARRAQKLWRAEAKAKQEAQLKPHLAAY

SEQ ID NO: 5495 - protein, 32 aa, Artificial Sequence
  Computer-generated peptide variant
KWKLLQKWYRKFKRPLLAACLAAMAEIRVPSH

SEQ ID NO: 5496 - protein, 34 aa, Artificial Sequence
  Computer-generated peptide variant
LWRMYKKLIKWWRNKQLLVLKNDADLRVRKALAL

SEQ ID NO: 5497 - protein, 51 aa, Artificial Sequence
  Computer-generated peptide variant
FIRLLSKIFRLLKKRDRPKKHHLRFARKCACAYPRKRALGMLLRSRLCLTK

SEQ ID NO: 5498 - protein, 31 aa, Artificial Sequence
  Computer-generated peptide variant
FLKLLRKFIRIWNRRMHFALARYLGGANALK

SEQ ID NO: 5499 - protein, 56 aa, Artificial Sequence
  Computer-generated peptide variant
KLKLLSKLWKWLRRHYARHADKCAVFTCKYLYLQKANRWRLKLLDKRFGALKSAKW

SEQ ID NO: 5500 - protein, 40 aa, Artificial Sequence
  Computer-generated peptide variant
WIKYLNKMLKRLHRQLLKDAGAAVQPKVRLKAAARAGKPL

SEQ ID NO: 5501 - protein, 20 aa, Artificial Sequence
  Computer-generated peptide variant
YLKLFKRMLKKLRSAKADPY

SEQ ID NO: 5502 - protein, 51 aa, Artificial Sequence
  Computer-generated peptide variant
RFKLLRKLYKRLTPSIDTKLYRKRIDKKKNALVLLQPAAPSHQWHRQKLAL

SEQ ID NO: 5503 - protein, 51 aa, Artificial Sequence
  Computer-generated peptide variant
MIKLYRKFFKRLKKSLFLNAFRARRKSLLQALLYNKKYSRRHMAYTEACAL

SEQ ID NO: 5504 - protein, 53 aa, Artificial Sequence
  Computer-generated peptide variant
IYKLLKRWLRLFKRFTLSALLLNAKRTALGAHLQLFKGNPRAHPHVREDQRAK

SEQ ID NO: 5505 - protein, 65 aa, Artificial Sequence
  Computer-generated peptide variant
RFRFYCRWWRRFKKKQRPKKLWAAANVYYYGLLLFKLKRLRFHLALACGLTDSAEDQAKVLLKKH

SEQ ID NO: 5506 - protein, 20 aa, Artificial Sequence
  Computer-generated peptide variant
WYRLLHKLFRLFRSRRLYLN

SEQ ID NO: 5507 - protein, 43 aa, Artificial Sequence
  Computer-generated peptide variant
LLKLIHRILKFMPKEAKRMAKLLAFQMADARFAPMGNVDRRLL

SEQ ID NO: 5508 - protein, 64 aa, Artificial Sequence
  Computer-generated peptide variant
FLKILKRLLKILCKLALMQSRHLHLDIWATRAQADWYRRLRKSPWRKLDARFKLARKHCNNPSA

SEQ ID NO: 5509 - protein, 69 aa, Artificial Sequence
  Computer-generated peptide variant
LLRWMKRWFKWWNPAAARMFTLKLLDRWNAVAFYKAIKNAGCMLRKRRKTAQIFVGRKKVKFPKKRALA

SEQ ID NO: 5510 - protein, 20 aa, Artificial Sequence
  Computer-generated peptide variant
KLRLICRYFRMIKKALVRAL

SEQ ID NO: 5511 - protein, 70 aa, Artificial Sequence
  Computer-generated peptide variant
KFKLFKRFLRFLKRRKNASLCCDKVLAFRAAYPAAKQRGPGQERCWKGARKKHACAKWLATAWEAKQLGL

SEQ ID NO: 5512 - protein, 76 aa, Artificial Sequence
  Computer-generated peptide variant
LIKFLKRYIRRFKQRARDGIARARNYQTVARLLLVCRAARKAILVRKLHRLECKAKLMSKELQLQKFLFNALSAYN

SEQ ID NO: 5513 - protein, 28 aa, Artificial Sequence
  Computer-generated peptide variant
WLRILTRFFKKYKHLKADARLLWGRRHL

SEQ ID NO: 5514 - protein, 84 aa, Artificial Sequence
  Computer-generated peptide variant
WFRLLTRFLRKWKQVKLLLSLPACPEVLALEACIYPKREKVMRAALRAALLVCAEAFARRARRWALPDRMRHDMRKQGKKCSLD

SEQ ID NO: 5515 - protein, 68 aa, Artificial Sequence
  Computer-generated peptide variant
RLRYMRKILKRLRRLLQAKKACLGRRLRRCRLAATDEKNLKLFPLHSTKPMLPRLMKLKHKIHLNNAV

SEQ ID NO: 5516 - protein, 38 aa, Artificial Sequence
  Computer-generated peptide variant
KLRLMKKIFKKLQKCCAVLLDSKHRRPHFAAMECVKAA

SEQ ID NO: 5517 - protein, 69 aa, Artificial Sequence
  Computer-generated peptide variant
KLRFYSKYMKRLRPMRLENLKLDCILLALMWAISAQQKLEALLGSKYFQLLGRRFIRKNTLKKLRQLPL

SEQ ID NO: 5518 - protein, 49 aa, Artificial Sequence
  Computer-generated peptide variant
KYRFFKRFLRLLSSLRILSTKWLFYPDKLLLIKFQARRTLLKMSRRVLV

SEQ ID NO: 5519 - protein, 40 aa, Artificial Sequence
  Computer-generated peptide variant
RYRLLRKLLKKLKRILGALLRGAALQRRRHAEAACYDGRA

SEQ ID NO: 5520 - protein, 56 aa, Artificial Sequence
  Computer-generated peptide variant
ILRLLRRWYKLYNTLMAALRHDPLYDAFAPRKAAKHRLCDVSQKRQLDHIAARRLK

SEQ ID NO: 5521 - protein, 27 aa, Artificial Sequence
  Computer-generated peptide variant
KLKLYTRFMKKYKKHLAKRLLANALLT

SEQ ID NO: 5522 - protein, 62 aa, Artificial Sequence
  Computer-generated peptide variant
KFRLICRMLKRLNRTRLLRETVCSARQAKKFWARAADNALERYGDRNLALAVRKIALLFCFK

SEQ ID NO: 5523 - protein, 23 aa, Artificial Sequence
  Computer-generated peptide variant
KLRMWKRLMRWLQPTLLRAMIKS

SEQ ID NO: 5524 - protein, 41 aa, Artificial Sequence
  Computer-generated peptide variant
MLKYLKKWFRRYHNFRFLHLHKLLRLPDLKKLEVGKRRRAN

SEQ ID NO: 5525 - protein, 33 aa, Artificial Sequence
  Computer-generated peptide variant
RFKFLKRILRRLRHTFLVTLKAALVAMGRKRQF

SEQ ID NO: 5526 - protein, 29 aa, Artificial Sequence
  Computer-generated peptide variant
FLRMFSKFLRWYNQPRRLFAARLLQERAR

SEQ ID NO: 5527 - protein, 58 aa, Artificial Sequence
  Computer-generated peptide variant
KYKIYCRFMKKLRTLRCTLLELCFRLNRAMCIWLRKLLRKLKRNKLATAWKINKRTCN

SEQ ID NO: 5528 - protein, 65 aa, Artificial Sequence
  Computer-generated peptide variant
ILKWMTKFLRFLRRRVPLRKQRLGLPRSMPRLARLLLILKIYTLWLMSRLLGGWRKRRWLKRPRR

SEQ ID NO: 5529 - protein, 37 aa, Artificial Sequence
  Computer-generated peptide variant
RLRFLTRLYRWLTRVCLKKDLKAIKLGLTIAGKLCEN

SEQ ID NO: 5530 - protein, 28 aa, Artificial Sequence
  Computer-generated peptide variant
FMRLLRKMIRKFPKAHRYACKVYANAAL

SEQ ID NO: 5531 - protein, 37 aa, Artificial Sequence
  Computer-generated peptide variant
LFKFFKRLFKYLPCKFKEWMLKRAKILKRCNHVALLK

SEQ ID NO: 5532 - protein, 56 aa, Artificial Sequence
  Computer-generated peptide variant
FIRYWRRLLRRYRKWKGSAQPRRIRKWLQDQLLAAPAELANKAMLFWNHLSLKATK

SEQ ID NO: 5533 - protein, 58 aa, Artificial Sequence
  Computer-generated peptide variant
KLRFIKKIIRLFRRCMALKLARTRKCVAAKAKAHHMLKCARLWGHWIKNWDRYDRRLL

SEQ ID NO: 5534 - protein, 73 aa, Artificial Sequence
  Computer-generated peptide variant
RFRMLKRFMRRLRKLARKLRHAVSHLNFEERCRRQECKAALPLEGNARGSKPLIRILAKSRMARKHLEAKAPC

SEQ ID NO: 5535 - protein, 29 aa, Artificial Sequence
  Computer-generated peptide variant
RWRLFKKYLKLLRHRCAHCKWDLKPNAFM

SEQ ID NO: 5536 - protein, 21 aa, Artificial Sequence
  Computer-generated peptide variant
KLKILTKMWKKLRTDLKMVAL

SEQ ID NO: 5537 - protein, 38 aa, Artificial Sequence
  Computer-generated peptide variant
RLKMLKRLMKFYRSSHIWVRCRKAAAKRLLGLCQAVCK

SEQ ID NO: 5538 - protein, 45 aa, Artificial Sequence
  Computer-generated peptide variant
RIRLLPKWWRLYRRSCLMKPARHALFKEILAHQGKGAKRAPRALV

SEQ ID NO: 5539 - protein, 20 aa, Artificial Sequence
  Computer-generated peptide variant
WMKLIKKLLKFMQKREALYS

SEQ ID NO: 5540 - protein, 30 aa, Artificial Sequence
  Computer-generated peptide variant
RFRLFKKYFKLIKKLRVRRQMYLRLALLIC

SEQ ID NO: 5541 - protein, 38 aa, Artificial Sequence
  Computer-generated peptide variant
RLKLFKKMLKWYNRARCARILAWLWVLKNYIRAFNEIR

SEQ ID NO: 5542 - protein, 77 aa, Artificial Sequence
  Computer-generated peptide variant
YFKFLRKIMRRFKHKLKQFKRLPRTKFNKKQYYDRLILLEFLLTFLKLAADAATALAPKLAGKDRKFAKQNHSYAKK

SEQ ID NO: 5543 - protein, 64 aa, Artificial Sequence
  Computer-generated peptide variant
RWRLLRKLLRRLKKLTEMKACNAERLLGRRRPRKMMLRQKHKKALWNQLGAQSMLLLCETLAED

SEQ ID NO: 5544 - protein, 63 aa, Artificial Sequence
  Computer-generated peptide variant
WWRILRKLLRRLRHLCRKAKLRQMPLKESADFRFCAWEGDHAQDAAVSKRKKQMKNRLKKMAG

SEQ ID NO: 5545 - protein, 60 aa, Artificial Sequence
  Computer-generated peptide variant
RMKLLPRFFKKMCPRLYCKHAYFHNPLKKRAPLFRLQLIFLKGAESLKLRRRARMPRLWL

SEQ ID NO: 5546 - protein, 40 aa, Artificial Sequence
  Computer-generated peptide variant
KMRWMKKFLKMLKRFLALRQKAGLEARLIVQIKGINRRIP

SEQ ID NO: 5547 - protein, 23 aa, Artificial Sequence
  Computer-generated peptide variant
FLKLMTRYIRLFRNNRAYKIAAA

SEQ ID NO: 5548 - protein, 40 aa, Artificial Sequence
  Computer-generated peptide variant
ILKMINKILKRISRLLAYDRHNMKKHALPLAKPAFLPMAR

SEQ ID NO: 5549 - protein, 80 aa, Artificial Sequence
  Computer-generated peptide variant
LLKLLHKLWRYMNRLECDHARAGLAKKMFAKAAARLSLRHKSGMKADFARLYRLKKGDSKAKKHLKKCVGMTEVLRKDQL

SEQ ID NO: 5550 - protein, 29 aa, Artificial Sequence
  Computer-generated peptide variant
FFKWLKRLYKFLSHNIRALCRLAELKKAK

SEQ ID NO: 5551 - protein, 81 aa, Artificial Sequence
  Computer-generated peptide variant
FWRFIRRFYKKLRKDKHKRSALLSDNKMKLRANIAADRRIDSSRKARARDRPRGILPREPLALYAFKARSKLMDCAAYAIM

SEQ ID NO: 5552 - protein, 80 aa, Artificial Sequence
  Computer-generated peptide variant
RFKYLRKFYKKLCKLFQTNLALPDMEVARQDKVHAPAKFAADLLWAKQLMAKKMWKRGLLGKKYMRALLDLKIAAEAGHA

SEQ ID NO: 5553 - protein, 50 aa, Artificial Sequence
  Computer-generated peptide variant
RWKLYRRLFRILNQYIAHKLGKRLKRILQRLACVKSLYLAQRKLNMLTSW

SEQ ID NO: 5554 - protein, 83 aa, Artificial Sequence
  Computer-generated peptide variant
KLRMLKKWIRFICRIDLKWAGTRRKQECAANRAWKPLKRNSWRAAFIGCHRRENKKAVMKWRRIYAKFSAALNLLLHFKALLR

SEQ ID NO: 5555 - protein, 60 aa, Artificial Sequence
  Computer-generated peptide variant
RIKFLKKLFRMLRSAKSQQKKARMLRAPLLRLNVMSRRYDVRHANLARACFGFLADNGKD

SEQ ID NO: 5556 - protein, 65 aa, Artificial Sequence
  Computer-generated peptide variant
LLKILRKLYRKFKKACYWWYAVTNNQCAQYSRALKRQKRHRCHLRLAAADNKLCAKALAAIDSLL

SEQ ID NO: 5557 - protein, 29 aa, Artificial Sequence
  Computer-generated peptide variant
LWRLLNKILKLFSSIRKHLKLAKKYYSAL

SEQ ID NO: 5558 - protein, 100 aa, Artificial Sequence
  Computer-generated peptide variant
RMRFFRRLYRRLKSHRVLMLTLTMRNHLLCSKLSQRKYLRKNLLKIAAVMWLRARWRPLRKAVDLNLHLRHGLQLLAWFRLSPAKALAAHNKAEPPAWEV

SEQ ID NO: 5559 - protein, 70 aa, Artificial Sequence
  Computer-generated peptide variant
MMRLFRRLFKKLRKLGDTADAKKNKKYHSSWRALMKEHRVTKKETAAKARLMNRLLSLNGLAQLNVAPKF

SEQ ID NO: 5560 - protein, 49 aa, Artificial Sequence
  Computer-generated peptide variant
FLRIMKKLLKKMHRRWLSLALRMGPMHMKARKLYRALAFKACRSQHPLA

SEQ ID NO: 5561 - protein, 67 aa, Artificial Sequence
  Computer-generated peptide variant
MFKLFKKWWKMFKSKENKQRILALKNLSRLPFHIRKARQATQQSKEHLKKKKLAKLMLYQLFAQRKA

SEQ ID NO: 5562 - protein, 23 aa, Artificial Sequence
  Computer-generated peptide variant
RMKMLPKLFRKLNRAGRGGQSAL

SEQ ID NO: 5563 - protein, 61 aa, Artificial Sequence
  Computer-generated peptide variant
RWRIFPKILRYLRTMHALGAKFQKRAQTKKQLALKARRFKATKKRKAALAKFRMNTKQCAR

SEQ ID NO: 5564 - protein, 61 aa, Artificial Sequence
  Computer-generated peptide variant
RYRWFRRYLKKFRKYATLNAMKCQRELLLWQIKKLGLTRARKAMASAPRHLKLWLLDIKVD

SEQ ID NO: 5565 - protein, 64 aa, Artificial Sequence
  Computer-generated peptide variant
RFKLLKKLLRFYKKEPRYMLRGREYRPSAHTCATRALKCWGATLRCTNRRAQARARFQGKRAAP

SEQ ID NO: 5566 - protein, 25 aa, Artificial Sequence
  Computer-generated peptide variant
RLRFLRKFWRLWTRAMGLRRDASLQ

SEQ ID NO: 5567 - protein, 25 aa, Artificial Sequence
  Computer-generated peptide variant
LFRYFKRLLKRIKNTAFKLLLAARL

SEQ ID NO: 5568 - protein, 30 aa, Artificial Sequence
  Computer-generated peptide variant
KLRLFRKLLRKYPPAKYAIMIRCITGQLKR

SEQ ID NO: 5569 - protein, 48 aa, Artificial Sequence
  Computer-generated peptide variant
RWRIYKKLLKKLHPKKAATPNAPRLLRKPRSMVRNAAGRLSTARRKLT

SEQ ID NO: 5570 - protein, 29 aa, Artificial Sequence
  Computer-generated peptide variant
LFKLIRKFFRLIRCLALKNDNLLYKLKLK

SEQ ID NO: 5571 - protein, 60 aa, Artificial Sequence
  Computer-generated peptide variant
RMRWLKRFMKWFQSNRKLCHLKKAHVIGFIKALAMRAALWKYDLMDAKLQRNRVLATALL

SEQ ID NO: 5572 - protein, 58 aa, Artificial Sequence
  Computer-generated peptide variant
IFRLWRRYLRRLPKLILNIAWDAPLGNRLRRPMAYALLDRFRVFKARPRAPLGPRQRM

SEQ ID NO: 5573 - protein, 58 aa, Artificial Sequence
  Computer-generated peptide variant
RLKFLNRMIKKYKKAMKPIVHALACRRPILKIHFKLGRMARKRLWKAELSWEMKCLLK

SEQ ID NO: 5574 - protein, 46 aa, Artificial Sequence
  Computer-generated peptide variant
LLKIYCKFLRRLSHRNCRKAGQIAANAAARACCCRVKHRKRRQKIN

SEQ ID NO: 5575 - protein, 63 aa, Artificial Sequence
  Computer-generated peptide variant
FYKWIKRYYKKMKKKCMEADKCALALMKLVAANLKAHSKRPCLALKARKKAKVERQPTKDWLA

SEQ ID NO: 5576 - protein, 34 aa, Artificial Sequence
  Computer-generated peptide variant
FYRWLRKILKRIRKQATSAKLARTKLKHPYDYAA

SEQ ID NO: 5577 - protein, 24 aa, Artificial Sequence
  Computer-generated peptide variant
ILRMLQRLFKKWRKSWQAARKGAS

SEQ ID NO: 5578 - protein, 64 aa, Artificial Sequence
  Computer-generated peptide variant
RLKIIPKFLRFFTHLCAPRKRVYRKLKIWKWLWAAASCDIAALKRALRKKRALLTHAQLIKAKR

SEQ ID NO: 5579 - protein, 73 aa, Artificial Sequence
  Computer-generated peptide variant
YWRYFRRYIKKWQKSLNVAALKSLLRKVKLAAHWLKGWCLLLRLEEPRMLRRRLKAPKLSICQLSVAAAALKK

SEQ ID NO: 5580 - protein, 72 aa, Artificial Sequence
  Computer-generated peptide variant
FLKFLSRWIKRLKKLCLPALRQAKRKARPLLKLMRGCGWQMICSKYRPCLAHKKFRPASKPARLKLTWDTNK

SEQ ID NO: 5581 - protein, 52 aa, Artificial Sequence
  Computer-generated peptide variant
LIRFFTRLLRLYRKLSKQAPDLRYKIKQPAQERLRKDKLRKYSDHVLRKADM

SEQ ID NO: 5582 - protein, 80 aa, Artificial Sequence
  Computer-generated peptide variant
WLKFLRRILKRFKTLFNNEDLLRARWPGEKSCCFLRKDQRQGARIQLRKRLWSIRHAAKAIGRRAAMAAIYIRADKMRAA

SEQ ID NO: 5583 - protein, 41 aa, Artificial Sequence
  Computer-generated peptide variant
RYRLLRKLLKLLPKTYKELALLLPQARGLKKKLMCKLAPDI

SEQ ID NO: 5584 - protein, 32 aa, Artificial Sequence
  Computer-generated peptide variant
RLRLFQRWMRKLKCDFYAKLWAYPYLKADADK

SEQ ID NO: 5585 - protein, 50 aa, Artificial Sequence
  Computer-generated peptide variant
IFRYLRRMFRFLKRSKQAMRWLAGDLCLFMKACDYLLRLMDKKMLAAKAR

SEQ ID NO: 5586 - protein, 31 aa, Artificial Sequence
  Computer-generated peptide variant
RFKYWKKLFKLLTRMIGKLLELRLNPQAKLK

SEQ ID NO: 5587 - protein, 40 aa, Artificial Sequence
  Computer-generated peptide variant
KMKYFKKLWRIYKNDRLETLAKRCALEDQRCRLRRAHAFA

SEQ ID NO: 5588 - protein, 49 aa, Artificial Sequence
  Computer-generated peptide variant
KLKLMKRLFKKLHHLLKAKLCRPRMESKRFIPAKAKSACLNQKELIKMW

SEQ ID NO: 5589 - protein, 32 aa, Artificial Sequence
  Computer-generated peptide variant
KLRLWRRIFKKLRKLDCSCEGAFLKLQIVAFL

SEQ ID NO: 5590 - protein, 51 aa, Artificial Sequence
  Computer-generated peptide variant
RYRMLRKFFRLYRKRLAQGARIMLVNLYEKRLLSNGYQDILKPARAARTLA

SEQ ID NO: 5591 - protein, 25 aa, Artificial Sequence
  Computer-generated peptide variant
FLRLMRRFYRLLTPLYLTSHVLRKA

SEQ ID NO: 5592 - protein, 52 aa, Artificial Sequence
  Computer-generated peptide variant
MMRFLCRMFKLLKKALRDLHTPLRYKMPARLCHKHLKRKKGAKHHTARMRKA

SEQ ID NO: 5593 - protein, 30 aa, Artificial Sequence
  Computer-generated peptide variant
LFKFFRRFLRRFHQRNLYKLKLALHFDLAM

SEQ ID NO: 5594 - protein, 63 aa, Artificial Sequence
  Computer-generated peptide variant
RWKLLKKMFRRLRSREKAWTKAVSLRKLDAAKRAKKKTITCKCLVGCFSKNLRWAAAVLIKSH

SEQ ID NO: 5595 - protein, 56 aa, Artificial Sequence
  Computer-generated peptide variant
FIKWFRKFYRRLKRIRAILAQAHSAMLVALRALACVKKCKRCYAQVSRLKVLGAVL

SEQ ID NO: 5596 - protein, 70 aa, Artificial Sequence
  Computer-generated peptide variant
KFRMFRKYLKWFKRPCWELDLLPKLRRIKSDCYKRKKKFLATVAQKKEADFLRMRMRDLRAALVAREGAL

SEQ ID NO: 5597 - protein, 33 aa, Artificial Sequence
  Computer-generated peptide variant
RIRLLRKLLRLFKREAYIKWELLHCGLRCVAGT

SEQ ID NO: 5598 - protein, 37 aa, Artificial Sequence
  Computer-generated peptide variant
RLRLLQKIIKFLRKWFKIRISRLTLMWPATRVLFRAA

SEQ ID NO: 5599 - protein, 53 aa, Artificial Sequence
  Computer-generated peptide variant
RWKLLKKLLKKLKKECKACLPLQMVKRSCAILALICRACKLDFCLSNLKWRTY

SEQ ID NO: 5600 - protein, 21 aa, Artificial Sequence
  Computer-generated peptide variant
RIKYFRKYLRFLRKAGNSALH

SEQ ID NO: 5601 - protein, 20 aa, Artificial Sequence
  Computer-generated peptide variant
LFKWYSRFMKLLRRLRPLIK

SEQ ID NO: 5602 - protein, 65 aa, Artificial Sequence
  Computer-generated peptide variant
KMRLLRKLWRYFSSLRRKRRMVFAKKYNRDAQVAHMDLLLRLAKYDLYKIGDGLRCARRLNLKKR

SEQ ID NO: 5603 - protein, 20 aa, Artificial Sequence
  Computer-generated peptide variant
WLRFLSRMLKKLKPACRWPR

SEQ ID NO: 5604 - protein, 40 aa, Artificial Sequence
  Computer-generated peptide variant
YIKLYTRLLKRYKRLRNARPLRTELETVRALWLHLAYLKR

SEQ ID NO: 5605 - protein, 35 aa, Artificial Sequence
  Computer-generated peptide variant
KYKLFRRLLKRLRHSKAYISPAITKKLSQLWAMRK

SEQ ID NO: 5606 - protein, 27 aa, Artificial Sequence
  Computer-generated peptide variant
RIKILKRLLRRIKTQVAQAYAKLKMCL

SEQ ID NO: 5607 - protein, 40 aa, Artificial Sequence
  Computer-generated peptide variant
KLKMMKRFFRLFSSACKKGILALPKAWSALLFKDKRRTKE

SEQ ID NO: 5608 - protein, 89 aa, Artificial Sequence
  Computer-generated peptide variant
KFKLFKRLLRKYPKLAAHKARRAELPKRELKKEARADREVLLSPLWRRFAFGKQAALGMKYKKRNKFKLRLGPQLCRFTRLMVTTPSYD

SEQ ID NO: 5609 - protein, 54 aa, Artificial Sequence
  Computer-generated peptide variant
RWRFIRRILKRLHHPAALMTAAKLATSVPEKAKLGRKLTYLMHTAKKLLCEKQI

SEQ ID NO: 5610 - protein, 46 aa, Artificial Sequence
  Computer-generated peptide variant
KLRMWKKFIKRFKRHAVKAALRGGRLTLAHSDKNLFRPAKMAKYLA

SEQ ID NO: 5611 - protein, 56 aa, Artificial Sequence
  Computer-generated peptide variant
LLRLLRKIFKYLKSFRKLAKAEKIQLRLRCAKLSLRASIMTSYALKDAQWLLCRRR

SEQ ID NO: 5612 - protein, 38 aa, Artificial Sequence
  Computer-generated peptide variant
RFKWLKKFFKLLKCREEALMELNATAHLKKRQVGRHFK

SEQ ID NO: 5613 - protein, 70 aa, Artificial Sequence
  Computer-generated peptide variant
LIRWWHKFIKKFNKPITVGRWAAGVNAKLKKQANRAAAASPKWPHKRRLRLRACRVARLRVREKAEGRVK

SEQ ID NO: 5614 - protein, 29 aa, Artificial Sequence
  Computer-generated peptide variant
YLRYINRLLRRLKRAKLYDIADQRKLSAR

SEQ ID NO: 5615 - protein, 34 aa, Artificial Sequence
  Computer-generated peptide variant
LFKFLTRLWRKFQSLTQAFWVRGKLRRARRLWRL

SEQ ID NO: 5616 - protein, 27 aa, Artificial Sequence
  Computer-generated peptide variant
KLRWLRRWLRKIRTRQAKIAFLSFLLQ

SEQ ID NO: 5617 - protein, 28 aa, Artificial Sequence
  Computer-generated peptide variant
RLRYYPKYLRKLKHLKMATKMGVLEASR

SEQ ID NO: 5618 - protein, 52 aa, Artificial Sequence
  Computer-generated peptide variant
RWKLIKRMLKILPTLHAKPSAARRALLGMLKITLRKFKRKLRPRLGARIRLL

SEQ ID NO: 5619 - protein, 92 aa, Artificial Sequence
  Computer-generated peptide variant
IFKLFKKLMKMLKRNVLALILRRYGCLGRAKKKKLRLWNGTYWDRRGARGSHICKIMHAKLKGCLRERHMKKGALTKVLLLKKAVWALYKSC

SEQ ID NO: 5620 - protein, 38 aa, Artificial Sequence
  Computer-generated peptide variant
RIRFYRKFLKRWKPSFHRLANAQAKTQKHGELAKTLAL

SEQ ID NO: 5621 - protein, 28 aa, Artificial Sequence
  Computer-generated peptide variant
LLRILKRLIRRMNKLFGPLDKEGAQALM

SEQ ID NO: 5622 - protein, 49 aa, Artificial Sequence
  Computer-generated peptide variant
LFKLIRKFLRKFTRELGLKPAKLKHRRAALYCGHYLAPHRKNKWGVWWL

SEQ ID NO: 5623 - protein, 75 aa, Artificial Sequence
  Computer-generated peptide variant
FIKWWRRLWKLMRRNKNHREWAEPAARNAALVKRRIKKVAGMLLLKFKHVLRSACCFDLREAAKSNRKVQARLWL

SEQ ID NO: 5624 - protein, 90 aa, Artificial Sequence
  Computer-generated peptide variant
KLKLLKRLYRKWPRLRRYKPKRFMMKMALDWFVNHLLSFVKARMFAFRLKNRPARRHLNEPYRSKAVGRMKCWWAKPCLLAKLWHLWALR

SEQ ID NO: 5625 - protein, 81 aa, Artificial Sequence
  Computer-generated peptide variant
KWKWYRKFLKKFKSIRELRKLKRLRGCQRARHLPPHCAKQQKEKALLSLHKSVRRLYLYAWIARCAKCRKLSWRIMDLAAR

SEQ ID NO: 5626 - protein, 74 aa, Artificial Sequence
  Computer-generated peptide variant
RYRWLRRFLKLLRRRSQACVTRLLYKKRHQLLARTHLVDKLSTYKPDKKKLRAASINVFQAALNIKDWCLTRER

SEQ ID NO: 5627 - protein, 72 aa, Artificial Sequence
  Computer-generated peptide variant
WIKMLRKLIKRLQCYAAHLLLRRRRASLLKARAAKKRRVEIRWRRHYLLLWNDTCLWAMVRRCKNYHWKGRD

SEQ ID NO: 5628 - protein, 46 aa, Artificial Sequence
  Computer-generated peptide variant
KLRILCRLYRRWRHKKEQKMLLKKDFMAFMIALLQKAAPVYFLVRR

SEQ ID NO: 5629 - protein, 20 aa, Artificial Sequence
  Computer-generated peptide variant
FLRMLTKLFRKMRRLFQTKA

SEQ ID NO: 5630 - protein, 79 aa, Artificial Sequence
  Computer-generated peptide variant
KWKIWQRIFRMINCPCLRRKLKGPALGARKLEKRMTKTAKKIELNARRRIAQRERFLAAKFAARTALFKKHKNQATATV

SEQ ID NO: 5631 - protein, 82 aa, Artificial Sequence
  Computer-generated peptide variant
FFKFWHKMYRMFRQAEKPAGNHHEARATCRIKNNKEKLLKKKYKQRWAKDLQYALSKLRKEAAAAAILASKRGARRKRCKFK

SEQ ID NO: 5632 - protein, 26 aa, Artificial Sequence
  Computer-generated peptide variant
LLRLLRKFFRKFRHERNMCIYLLRAA

SEQ ID NO: 5633 - protein, 84 aa, Artificial Sequence
  Computer-generated peptide variant
RMKIWTKFIRLFRKRNKHGLAKRQIVLKRKRIKAQVAALQVDLLDPNLAWAKSYKRDKELCDAHLTKANHRLASQKLRKACLAQ

SEQ ID NO: 5634 - protein, 49 aa, Artificial Sequence
  Computer-generated peptide variant
WMKFWKRYFKRLTRQFLRGQWMKKQAKALLLQVARLSNTKPSFLARLKL

SEQ ID NO: 5635 - protein, 32 aa, Artificial Sequence
  Computer-generated peptide variant
RWKWWHKLFRRFRRMALKYAREQANLRSWLKA

SEQ ID NO: 5636 - protein, 28 aa, Artificial Sequence
  Computer-generated peptide variant
RIKLWHRLWRLWPRAQANAARCPLKRDL

SEQ ID NO: 5637 - protein, 58 aa, Artificial Sequence
  Computer-generated peptide variant
RWRYFKRFLKKFRKTRENQLRHCYCAAAAFLARAKWAALADIRLAQKLRYRYNYDAYN

SEQ ID NO: 5638 - protein, 36 aa, Artificial Sequence
  Computer-generated peptide variant
YFKLFRRFLRLMKKLNERKLPRFALVLRWKDLLLYA

SEQ ID NO: 5639 - protein, 21 aa, Artificial Sequence
  Computer-generated peptide variant
LLRIYSKFWKKWQKLNKAKLS

SEQ ID NO: 5640 - protein, 47 aa, Artificial Sequence
  Computer-generated peptide variant
LLRLYKKLWRKIKKNRKKQCCETWLIDRAMVGARLPYLARLNACKLG

SEQ ID NO: 5641 - protein, 55 aa, Artificial Sequence
  Computer-generated peptide variant
FLKIIKRFLRLLRKATKRPSSYSAKRWKEDLFKLDIHRKKLLPICSAETKAADAA

SEQ ID NO: 5642 - protein, 32 aa, Artificial Sequence
  Computer-generated peptide variant
FFKILQRMYRKFHKKELAKAARRPLRWFLVAC

SEQ ID NO: 5643 - protein, 91 aa, Artificial Sequence
  Computer-generated peptide variant
LMRFYHRLFRKIRTIKKRMKRHYSAANRIRDIKTWVNRAIRARAELLVRERLLRAYLKLRLFDETRCLFQKLNHFMEALFRLAAAAKSRSK

SEQ ID NO: 5644 - protein, 30 aa, Artificial Sequence
  Computer-generated peptide variant
LLRLFRKLLKILHKPKTARKAASKGKTIRL

SEQ ID NO: 5645 - protein, 88 aa, Artificial Sequence
  Computer-generated peptide variant
WIRIYKRMFRKFRCAAILRNFYLKLRDQFIFKKIKLGRTDARTAAKLQAARYRRLKAPAANAKAKMKRVTYVATWIYLEKLAAKYNKW

SEQ ID NO: 5646 - protein, 63 aa, Artificial Sequence
  Computer-generated peptide variant
RWKLFCKYLRKFKRLLYRAAAYELLVQRSADYASRMRCLILWATKRFVYRPIHKARDARKGLR

SEQ ID NO: 5647 - protein, 54 aa, Artificial Sequence
  Computer-generated peptide variant
KLKWYPKLLRIWRRAPALGTTRALDMKTLEIRASKYLREAGARTWKALQLQASL

SEQ ID NO: 5648 - protein, 21 aa, Artificial Sequence
  Computer-generated peptide variant
KLRLYKKLLRLFRRQAKLPRA

SEQ ID NO: 5649 - protein, 37 aa, Artificial Sequence
  Computer-generated peptide variant
KIRLFKKFLKKLKRGNLIKKRSLFWDYHAADLWAQLI

SEQ ID NO: 5650 - protein, 71 aa, Artificial Sequence
  Computer-generated peptide variant
LLRLMNKFFRRLRKNLYWGNNKKNAKRARRALVLKKAVDVDEARLMACVLRRLPIIDLRLNRGIHEAYRFR

SEQ ID NO: 5651 - protein, 85 aa, Artificial Sequence
  Computer-generated peptide variant
KYKLYSKFLRRLQSLKLDPEIKLKMQNDYGKARLSWCPKLLKAVTQLLRKKLFWKLPRQKQRAMRGLKKQKLGMRQANRKRLALH

SEQ ID NO: 5652 - protein, 34 aa, Artificial Sequence
  Computer-generated peptide variant
KLRIWRRMWRMLKSEKLAAAYWCCLLLQKLWATH

SEQ ID NO: 5653 - protein, 26 aa, Artificial Sequence
  Computer-generated peptide variant
LIRIFTKLLRLIRRNKGLRLVMLSAR

SEQ ID NO: 5654 - protein, 40 aa, Artificial Sequence
  Computer-generated peptide variant
RIRYLRKLYRRLQKAAFKDWRSLCAYDARMYRRKHETLAL

SEQ ID NO: 5655 - protein, 48 aa, Artificial Sequence
  Computer-generated peptide variant
FYRWLCRLLKKIKSYLRMAPQKKTSNRELMLYTLRAGWHRRQALRRAL

SEQ ID NO: 5656 - protein, 41 aa, Artificial Sequence
  Computer-generated peptide variant
LFRLLRKFYKILKKQLALHRSTKDQYLDKRQARLKKYAASH

SEQ ID NO: 5657 - protein, 49 aa, Artificial Sequence
  Computer-generated peptide variant
KLKFIRKYLKRFTRRLAAKLSHADLCLDAVCQLRHTEAVDRQLKIACNA

SEQ ID NO: 5658 - protein, 50 aa, Artificial Sequence
  Computer-generated peptide variant
LIKLLKRLYKKWKKTLKRQLLKAPMCARVKIRDIQERCYDAMRHASAKAA

SEQ ID NO: 5659 - protein, 39 aa, Artificial Sequence
  Computer-generated peptide variant
RIKFMKKLLRKFPRHKLLLYKCSARTAAVVAAMKPQGKC

SEQ ID NO: 5660 - protein, 47 aa, Artificial Sequence
  Computer-generated peptide variant
LIKMYQKYLRKIRRRAKAECDPRIYADLELRAAAMLCMRKLAPPNAK

SEQ ID NO: 5661 - protein, 48 aa, Artificial Sequence
  Computer-generated peptide variant
WLRIFSRLFRKLKCLKAWILMSLQRRPKALKKCWLGRAGGRYNLKKCE

SEQ ID NO: 5662 - protein, 22 aa, Artificial Sequence
  Computer-generated peptide variant
LIKILRKLFRIIKKREAYWYLA

SEQ ID NO: 5663 - protein, 82 aa, Artificial Sequence
  Computer-generated peptide variant
RLRFLKKFIKKFKKDRAQGKLKKFLLFPYAQWAKAKHKIAHLNLTAAAAPYVKAFFKPARCLLAKRWKYMRAGGVILFFLLQ

SEQ ID NO: 5664 - protein, 51 aa, Artificial Sequence
  Computer-generated peptide variant
RLKLYKKLFKMFQRLILNALRKYYCAAHWALAVLRKSERCCRAHMAATACK

SEQ ID NO: 5665 - protein, 51 aa, Artificial Sequence
  Computer-generated peptide variant
LLRLWNRLMKLLRHMRRDRRLRDWLTKPFWKIRERTLWRVVALRRLWKAAW

SEQ ID NO: 5666 - protein, 33 aa, Artificial Sequence
  Computer-generated peptide variant
KLKLFKKMLKKISRIRRLKQMRVRDLAANACLA

SEQ ID NO: 5667 - protein, 65 aa, Artificial Sequence
  Computer-generated peptide variant
LLKLFTKFIRLLPNLRRLAVPSKPDLLALPKKARWAVDSDNKKQTMRLKMTKRKIKDHGAAAVRN

SEQ ID NO: 5668 - protein, 49 aa, Artificial Sequence
  Computer-generated peptide variant
KYKFLNRFYRLFKKETRCPWLALNLLVLRIDLRTKRRANKDAGAALKKR

SEQ ID NO: 5669 - protein, 52 aa, Artificial Sequence
  Computer-generated peptide variant
KWKLWRKLLKLIRCAYLLFKLSHNVQLTKARLDMQIANKTSLFVKRLPLRRW

SEQ ID NO: 5670 - protein, 56 aa, Artificial Sequence
  Computer-generated peptide variant
KWRIFTRYMRKLNHAQMNLTLKKARKQIAAAMASAERLAYALYSVKKLKRLLRAAR

SEQ ID NO: 5671 - protein, 45 aa, Artificial Sequence
  Computer-generated peptide variant
IFKFLCKWMKKLNRKKTDKAVLNHKKLRALARRQAVSLFRNKSYA

SEQ ID NO: 5672 - protein, 25 aa, Artificial Sequence
  Computer-generated peptide variant
LLRWLRRLLRLYRKLTQKAEADPRG

SEQ ID NO: 5673 - protein, 78 aa, Artificial Sequence
  Computer-generated peptide variant
RYKWWKRLFRRYSCKKRAVARLTAAQLAMRILWQFRLIFYFKRKKCWKANVHVCHRLQKIRKRAVYAALLRLLHNRKP

SEQ ID NO: 5674 - protein, 32 aa, Artificial Sequence
  Computer-generated peptide variant
ILKFLTKLIRKFKKAQYRLFAHCSAAMLAKRL

SEQ ID NO: 5675 - protein, 50 aa, Artificial Sequence
  Computer-generated peptide variant
RLRLFTRMFKWFKRRRAKRKQLSWYRLQWTIRLLCALKRKHDLLKLLTQR

SEQ ID NO: 5676 - protein, 36 aa, Artificial Sequence
  Computer-generated peptide variant
FLRLWQRWLRRIKHPAALELLRKLKRLIKIMKEAYD

SEQ ID NO: 5677 - protein, 21 aa, Artificial Sequence
  Computer-generated peptide variant
KLKFFRKLMRYLSQAHAKHAR

SEQ ID NO: 5678 - protein, 37 aa, Artificial Sequence
  Computer-generated peptide variant
RFRLIRRMYRYLTTKQLLKRKLPHRFWDWLSAALARL

SEQ ID NO: 5679 - protein, 39 aa, Artificial Sequence
  Computer-generated peptide variant
RMKWLSRLMRKLKKYGRGAACYAFLAGDKLKAHTLNFKY

SEQ ID NO: 5680 - protein, 56 aa, Artificial Sequence
  Computer-generated peptide variant
LFRYFCKLFKKFRTYRPQWLLRRSLVRANMRRKRRTNLAARRLLDCLHPYLDRKWE

SEQ ID NO: 5681 - protein, 31 aa, Artificial Sequence
  Computer-generated peptide variant
MWRLYHRLIKLWKRAAVTKLKKLHGICHLLK

SEQ ID NO: 5682 - protein, 50 aa, Artificial Sequence
  Computer-generated peptide variant
FLRYLKRFLRLFKKLEHRPLKLNVNLPAKRHNKDTIKARDAFKRVNCLRD

SEQ ID NO: 5683 - protein, 76 aa, Artificial Sequence
  Computer-generated peptide variant
RLKFFTRFLKKWKCKDLHYLHALKAVAPRRKIRNVSEKLKAWVQNACLLRSLLRNHRRKKAFPDDKAKKAADQQQL

SEQ ID NO: 5684 - protein, 50 aa, Artificial Sequence
  Computer-generated peptide variant
FLKWLKRMLRRFHCAFSLLKMPVTEAARLRIRKIWARHRFYAMALKRKMK

SEQ ID NO: 5685 - protein, 20 aa, Artificial Sequence
  Computer-generated peptide variant
LMRIYKRYLKYLNRHLKLWA

SEQ ID NO: 5686 - protein, 94 aa, Artificial Sequence
  Computer-generated peptide variant
LFRFWKKFWKRLRKRAYLKCAYKRRWARVMYLKLVFMNKRLALALLQKHYLRFERLLIRTLLHRDDQSNEVQLKLRDHLRRKWLAPVSKAPALT

SEQ ID NO: 5687 - protein, 25 aa, Artificial Sequence
  Computer-generated peptide variant
RYRLWRKFWKKLKQILNKKLPAHAL

SEQ ID NO: 5688 - protein, 63 aa, Artificial Sequence
  Computer-generated peptide variant
KFRIMKKLLKFLSQFLKAKQPKIRKAKTWTLKVALHFKKYLRLKRAPLFSQKKRLKLDLSAKL

SEQ ID NO: 5689 - protein, 58 aa, Artificial Sequence
  Computer-generated peptide variant
LLKLWKKLLRILKKCTRDRLLAPSLQAANCHHYLKKKLRCTENSKQAKRFLEFEWPLL

SEQ ID NO: 5690 - protein, 22 aa, Artificial Sequence
  Computer-generated peptide variant
LFRLWRRLLRWFKSALDIADAK

SEQ ID NO: 5691 - protein, 72 aa, Artificial Sequence
  Computer-generated peptide variant
RFRYIKKLYKKLKCAKLHPKWYKLLRPENFSASPDLAWEVLPKADYSMLKLRRALRAGWYRYRLNLPKKRAL

SEQ ID NO: 5692 - protein, 36 aa, Artificial Sequence
  Computer-generated peptide variant
RMKLFQKILKYLRTFARQKAKLSAKMWHTPLLAKIK

SEQ ID NO: 5693 - protein, 46 aa, Artificial Sequence
  Computer-generated peptide variant
KYRFLRKFLRFLKKKAALAAQLVLAARAPVRSWWMVKTALTKKARA

SEQ ID NO: 5694 - protein, 41 aa, Artificial Sequence
  Computer-generated peptide variant
KLRLIRRILRKLPSRVRLWLQVPMDAEQRKLRLAVKQGKSY

SEQ ID NO: 5695 - protein, 65 aa, Artificial Sequence
  Computer-generated peptide variant
KMKLWTKIYRKLKREPASALIMFDLLRCRDAAVYRCALTKACVKLRLNQEAATLLKKLCVVTPLR

SEQ ID NO: 5696 - protein, 60 aa, Artificial Sequence
  Computer-generated peptide variant
KLKYWRKYMKKFRHKAKLARLCPQALAKKRAQDFLKQRKNYVMAARVDRVYLRTAKGMAL

SEQ ID NO: 5697 - protein, 32 aa, Artificial Sequence
  Computer-generated peptide variant
LIRIFRRLFRRYTKLNMANLTKLKKLSLIADA

SEQ ID NO: 5698 - protein, 66 aa, Artificial Sequence
  Computer-generated peptide variant
YYKIIPRIIRRLSRARLKLPNMAKRLFRHLHKKCYLALRLANLDRKAYNRKLVMFAAIEMLVAAVR

SEQ ID NO: 5699 - protein, 36 aa, Artificial Sequence
  Computer-generated peptide variant
RFKFLHKIYKFFKKARKALGATLAKEPLGRACDIAH

SEQ ID NO: 5700 - protein, 88 aa, Artificial Sequence
  Computer-generated peptide variant
KFRFIPRFYRLMQRYGMKAKCANLDAARKARKWRKAHIRQKLEATTLRAAHKSLPQALRALKSKIQRLKQRHLYKRTNKKFAHAKKQA

SEQ ID NO: 5701 - protein, 21 aa, Artificial Sequence
  Computer-generated peptide variant
LLKMLTRWLRRYRKPYNCSAR

SEQ ID NO: 5702 - protein, 67 aa, Artificial Sequence
  Computer-generated peptide variant
LYRILKRIYKWYQRKFALKAKKALREAANSREKRFLNAMDKEAHRQAILALPCAKLKVLRGAREWRL

SEQ ID NO: 5703 - protein, 29 aa, Artificial Sequence
  Computer-generated peptide variant
KWRFYKRWLKKWKNKACAKLFLLDALLAA

SEQ ID NO: 5704 - protein, 33 aa, Artificial Sequence
  Computer-generated peptide variant
LLRLFNRFLKLFSKWFANKLKCGPKNRKLPAAK

SEQ ID NO: 5705 - protein, 43 aa, Artificial Sequence
  Computer-generated peptide variant
KIRIFKKLLKKMKNLLRQIKCLGLSAKVARLRCYNCKRQCAQE

SEQ ID NO: 5706 - protein, 30 aa, Artificial Sequence
  Computer-generated peptide variant
RFKFLKRWFKKFKPLALAMSNNQRGDLARA

SEQ ID NO: 5707 - protein, 24 aa, Artificial Sequence
  Computer-generated peptide variant
RLRLIKRFLRRFTPLSYSAFRHKA

SEQ ID NO: 5708 - protein, 23 aa, Artificial Sequence
  Computer-generated peptide variant
KLRLLTKWFKKLNKLLKQYNTFR

SEQ ID NO: 5709 - protein, 52 aa, Artificial Sequence
  Computer-generated peptide variant
KMRLYTKFWKLIKQCATPTMAAVARAAQAIRHNAYKKAYRIELLLKQKAKAM

SEQ ID NO: 5710 - protein, 52 aa, Artificial Sequence
  Computer-generated peptide variant
FFKMIKRLLRRLKKMYLLGAAEKSKLNPIRLANWFAHKGVLRQAHLKNAHCR

SEQ ID NO: 5711 - protein, 90 aa, Artificial Sequence
  Computer-generated peptide variant
RIKLYQRFIRKLSSMETLAWAYYAHSTKAAKTYMWNRLATRRAIVSKAKEKRHKLWRICRARLKNIPSLLKVKCYACLLRKLLPAARRAK

SEQ ID NO: 5712 - protein, 31 aa, Artificial Sequence
  Computer-generated peptide variant
RLRLFKKILKKLSCLKVLRARLGIAFFRSEA

SEQ ID NO: 5713 - protein, 99 aa, Artificial Sequence
  Computer-generated peptide variant
RFRMYPKFLRLWNKICYAALRRREYEAKLRRNRRLCAIKRLMRNGRPVHALEWSQNALRAMRRARAQKRVLAVAKGHLAKIEALHVRAEAQRKADKASS

SEQ ID NO: 5714 - protein, 30 aa, Artificial Sequence
  Computer-generated peptide variant
LLKFWTKLFKRMRRSDQLGILRRAASDSRA

SEQ ID NO: 5715 - protein, 84 aa, Artificial Sequence
  Computer-generated peptide variant
KIKMMRRMYRRFSTRALRLKSLLKVKIEADPARKEMEAKLKAPRPKKGKLKTQAKVLNLCELLRNVSKQLVSPRLARNWALLLL

SEQ ID NO: 5716 - protein, 42 aa, Artificial Sequence
  Computer-generated peptide variant
MLRYYNKLLKLMKTKDLQLRKAICQYMAWAKWVALREWLLAK

SEQ ID NO: 5717 - protein, 32 aa, Artificial Sequence
  Computer-generated peptide variant
LIKLLHKIFKRWSCLDKAQLLDGRRVGAAYAR

SEQ ID NO: 5718 - protein, 45 aa, Artificial Sequence
  Computer-generated peptide variant
RWKFITKLLKRLRRLPTLRVKIMEFKASITKCLQSSWKKKALAAS

SEQ ID NO: 5719 - protein, 27 aa, Artificial Sequence
  Computer-generated peptide variant
LFKIWKKMLRRIRRAEGAWNANRDNAA

SEQ ID NO: 5720 - protein, 96 aa, Artificial Sequence
  Computer-generated peptide variant
LLKWYRKFWRKMQNKREHLLHGKLKWAWALLKVHMHVARPKNLSDAIKQNSALVIKLLQLKVFWRALRLAMHFARCAAAHLRLYKFKTQRLAKTKA

SEQ ID NO: 5721 - protein, 98 aa, Artificial Sequence
  Computer-generated peptide variant
KIRFLQKFIRKFPRHLLKLRLIQKLYGKSLACLKRLKIKAARICYASLRLLKDLKRRLQQACLQCLMSYLCRHAAKQALDKKKNVCVAWSGLRIAHRN

SEQ ID NO: 5722 - protein, 21 aa, Artificial Sequence
  Computer-generated peptide variant
RMKMMTRMWRFFKKLAAALKS

SEQ ID NO: 5723 - protein, 38 aa, Artificial Sequence
  Computer-generated peptide variant
KIRLINKIYRMITRPAAMLQFSAAIHKRALLKKMLKLT

SEQ ID NO: 5724 - protein, 40 aa, Artificial Sequence
  Computer-generated peptide variant
KLKLLRKILRLLPKCANAIMRILLYRRRNTECRKEAKDRR

SEQ ID NO: 5725 - protein, 29 aa, Artificial Sequence
  Computer-generated peptide variant
ILKYWKRLFRLLRHRAKTELRGTLHRSCF

SEQ ID NO: 5726 - protein, 40 aa, Artificial Sequence
  Computer-generated peptide variant
FWKLYQKLWKKLRRNEAHYRKMYAAKELLEHRRQGEHLRL

SEQ ID NO: 5727 - protein, 20 aa, Artificial Sequence
  Computer-generated peptide variant
LYKIWTKWFRMLKKFLAKAS

SEQ ID NO: 5728 - protein, 97 aa, Artificial Sequence
  Computer-generated peptide variant
KIKFLKKYMRFLNKLKAHQKAKAKVRGHRWKGKLRKDCKANRMRELYKRLQACKTHLKRAKQLQAVHAELRAKILRYMRRIENLAAAENRYQLPYDK

SEQ ID NO: 5729 - protein, 36 aa, Artificial Sequence
  Computer-generated peptide variant
KYKYFKKYLKRFKHCYACEAKLLNLAKCTWPLKKAN

SEQ ID NO: 5730 - protein, 57 aa, Artificial Sequence
  Computer-generated peptide variant
KFRFFKRFLKWMRCHALRYCTLRHARRERAFLGGNTMRAQLKGVLFDKLKNARRALL

SEQ ID NO: 5731 - protein, 32 aa, Artificial Sequence
  Computer-generated peptide variant
FFRFIRRFLRLLTKPMRAMWCAARKSLLLKRL

SEQ ID NO: 5732 - protein, 38 aa, Artificial Sequence
  Computer-generated peptide variant
LFRLLKRLFRLFRKLAHASKTMMLAAIETRTEDYGLRR

SEQ ID NO: 5733 - protein, 39 aa, Artificial Sequence
  Computer-generated peptide variant
ILKLFKKFLKKLCRALYRKFEAAKANLSAQAAVRTMSDN

SEQ ID NO: 5734 - protein, 63 aa, Artificial Sequence
  Computer-generated peptide variant
KLKLLSKFLRKYQHLSLAHIARAIKTMLISRLGFGDSNHPARKRSWLKAKRRCRKLLNPAGHK

SEQ ID NO: 5735 - protein, 73 aa, Artificial Sequence
  Computer-generated peptide variant
KIRLLHKYLKKFRRLRRRFKTLNRFYRYKWCAIKAQKLALKLQKLKKIILACSHGWRDRCPDRAFVFARALAM

SEQ ID NO: 5736 - protein, 43 aa, Artificial Sequence
  Computer-generated peptide variant
KFRLFKKFLKRLSRAFLAPQKYRLKPVIDKALRKHLGNQRATN

SEQ ID NO: 5737 - protein, 38 aa, Artificial Sequence
  Computer-generated peptide variant
RIKYLTKLFKFLHQKKHLKQHAALPLHLYKKAPDLPAK

SEQ ID NO: 5738 - protein, 47 aa, Artificial Sequence
  Computer-generated peptide variant
KIKLYHRFLKRLHHRAKRRARLLEYHLARHFASFWKRHWQAAPRNNY

SEQ ID NO: 5739 - protein, 55 aa, Artificial Sequence
  Computer-generated peptide variant
RLKLYRRWYRWLSKIHAAKNRYLRHLAQLRKDDLFLRFARVCQEHLLKKALCGLI

SEQ ID NO: 5740 - protein, 69 aa, Artificial Sequence
  Computer-generated peptide variant
KLRLLSRLWRRLKSDPYKNNKWRLKQYLIRLDKQALRLDLRSFAERNIMFWLGRLALKMQWMLDHFALA

SEQ ID NO: 5741 - protein, 67 aa, Artificial Sequence
  Computer-generated peptide variant
LLKWFSRFWKYLKKLAAKNELCKIVRAARKLWRLFRMAKMAAKDLYVMWNDKKVDWRINLEAQALKT

SEQ ID NO: 5742 - protein, 54 aa, Artificial Sequence
  Computer-generated peptide variant
YFKIFSRLYRRLRCVLLLTLKKFKLKALIKFLITGRGPRPVAAFAPRLAKKKKN

SEQ ID NO: 5743 - protein, 53 aa, Artificial Sequence
  Computer-generated peptide variant
FLRWMQRLWKIIQTRRPRNRHLLHRAAGIKPGLLRTQLQKELAKNRKRAKKPL

SEQ ID NO: 5744 - protein, 25 aa, Artificial Sequence
  Computer-generated peptide variant
KMRLYRRLLRFYQRRLAHLCAIELS

SEQ ID NO: 5745 - protein, 45 aa, Artificial Sequence
  Computer-generated peptide variant
FFRFMTKLFRKIRNAPAAKNNMSLLKRRYKLREEIGLYKRAALRF

SEQ ID NO: 5746 - protein, 49 aa, Artificial Sequence
  Computer-generated peptide variant
ILKLLKKWMRKIKQWHYLRCCANLVAKLPCRKAAARYRKLSKASEHFLC

SEQ ID NO: 5747 - protein, 86 aa, Artificial Sequence
  Computer-generated peptide variant
KLRFLKRMLKKLKKREIAARAARHTLLELHKKAKPSIRLTLHVVMGGLPRRFEWAYKPAYKCRWLRGLKSRACVRNKLGTKWNCTL

SEQ ID NO: 5748 - protein, 20 aa, Artificial Sequence
  Computer-generated peptide variant
FLRWFNRFIKKLQTAKPLAR

SEQ ID NO: 5749 - protein, 21 aa, Artificial Sequence
  Computer-generated peptide variant
KLKFLCRFFKKFRPKLLKALL

SEQ ID NO: 5750 - protein, 62 aa, Artificial Sequence
  Computer-generated peptide variant
RMRFFRKIMKKYNKKCKLFKNLAKKKAAANAAFLVLRAGSELLCNACLSYRNLKKPETAKWF

SEQ ID NO: 5751 - protein, 32 aa, Artificial Sequence
  Computer-generated peptide variant
LLKFWHRMFRMLRRLCMGALKPGQARRHRALF

SEQ ID NO: 5752 - protein, 45 aa, Artificial Sequence
  Computer-generated peptide variant
KFRMYSKMWKILKHNNAIRLLKLRASWRMKKHYRWYLAAKGAVRL

SEQ ID NO: 5753 - protein, 54 aa, Artificial Sequence
  Computer-generated peptide variant
RLKMLRKLYKLYTHAHGDPHWRPAFRELKRLYNLLSMYLALDRKTKRRARVYKK

SEQ ID NO: 5754 - protein, 92 aa, Artificial Sequence
  Computer-generated peptide variant
FLKLYKKILRKFRRAWLAGRSARACANLGRMAKLKTRTIKRIYLKANKACRTWLKCYKLLRHEERHECRRYRKSLPAPKRGGCAPKMVLKCR

SEQ ID NO: 5755 - protein, 43 aa, Artificial Sequence
  Computer-generated peptide variant
FLKIFCRWIRKIPRAFLHRLLLKHEKIRMGKLGRFLSKKAIKA

SEQ ID NO: 5756 - protein, 78 aa, Artificial Sequence
  Computer-generated peptide variant
YLKWLQKFLKRFRTQRTILAEFNWAAACKKIAASWLLAHLILDAKSAATNKRFPAKALNYKKKAAKVKKFVKLPQLAK

SEQ ID NO: 5757 - protein, 32 aa, Artificial Sequence
  Computer-generated peptide variant
IYRLMRKWLKFLRSKRAKYALKLRAGIKTMIS

SEQ ID NO: 5758 - protein, 85 aa, Artificial Sequence
  Computer-generated peptide variant
RIRILQRLIRFLRKGRRNIDAGATYRKMIGLAIAAAMARRHRTPAKRLAVRQAFLLLRKHLRLMKIDAFRPNAANLRLDGEAEPA

SEQ ID NO: 5759 - protein, 38 aa, Artificial Sequence
  Computer-generated peptide variant
FFKLLRRWWKLFKQTKDATLSKDALHQDKKNRAILRSA

SEQ ID NO: 5760 - protein, 40 aa, Artificial Sequence
  Computer-generated peptide variant
RIRLWCKLLRLMNRQEKHHAAFKLRKRRLVRAALPIRLKR

SEQ ID NO: 5761 - protein, 69 aa, Artificial Sequence
  Computer-generated peptide variant
FFRFIKRMLRLLKKEKIKARLAAIIKACLVKWLAFKKSNEKCLSRMGKARKAILDKRWYQIRALRVNMM

SEQ ID NO: 5762 - protein, 21 aa, Artificial Sequence
  Computer-generated peptide variant
RYRLLSKWLKLFKKRTSAYRL

SEQ ID NO: 5763 - protein, 28 aa, Artificial Sequence
  Computer-generated peptide variant
LMRFYKKIYRLLHKRRLIARLRATTAKL

SEQ ID NO: 5764 - protein, 31 aa, Artificial Sequence
  Computer-generated peptide variant
RWRLFRKILRFLRSCTKAQKKERVHLTADAA

SEQ ID NO: 5765 - protein, 25 aa, Artificial Sequence
  Computer-generated peptide variant
YWRLLRKMLRLFRNLPATLGRRCAV

SEQ ID NO: 5766 - protein, 60 aa, Artificial Sequence
  Computer-generated peptide variant
LMRWLKRLWRRYRRNKMLAHNCRRRAKAASWAARVLKKKANWVAWHGHLRRRPAAEHLIM

SEQ ID NO: 5767 - protein, 50 aa, Artificial Sequence
  Computer-generated peptide variant
LMKLLKKYYKRLQRRTGGPDLCRRKVYLDSTKKCAAQAKWDAAIALARLK

SEQ ID NO: 5768 - protein, 36 aa, Artificial Sequence
  Computer-generated peptide variant
LIKFFNRFYKRWRKRLEALEAGAILKTRALSAHVAG

SEQ ID NO: 5769 - protein, 44 aa, Artificial Sequence
  Computer-generated peptide variant
RFKFYRRLIKWMSKRSAWLPARLKRNTWLHHLQARLKKARKLPY

SEQ ID NO: 5770 - protein, 71 aa, Artificial Sequence
  Computer-generated peptide variant
FYKWLTKFFKYMRRKLRQRLSLHDREKAKKPKGLKAHRHRREHALLFKAAALYPSALDLYPVIALCVAKKL

SEQ ID NO: 5771 - protein, 36 aa, Artificial Sequence
  Computer-generated peptide variant
MWRIFRKLLRRMKKLCKLFWHDRRIWLQRAAAQNLG

SEQ ID NO: 5772 - protein, 40 aa, Artificial Sequence
  Computer-generated peptide variant
KMRLYNRILKRLKNRRLLADCARNAGKEDRNRMCRLLAPL

SEQ ID NO: 5773 - protein, 25 aa, Artificial Sequence
  Computer-generated peptide variant
KLRWYKKLYKRLRKTAIAEAHWKAP

SEQ ID NO: 5774 - protein, 49 aa, Artificial Sequence
  Computer-generated peptide variant
KLKLWKKLIKLFSRMLARKLDRQLATKMRMRAAGLNPACSIDRKRPDRQ

SEQ ID NO: 5775 - protein, 35 aa, Artificial Sequence
  Computer-generated peptide variant
RYKWFRKMLKLIRRGMKYTMPKKLELARAALCRTA

SEQ ID NO: 5776 - protein, 44 aa, Artificial Sequence
  Computer-generated peptide variant
ILRFLRKFLKKFNRKRLAILMAMTAWQALRRAARWKWQLYAQTW

SEQ ID NO: 5777 - protein, 45 aa, Artificial Sequence
  Computer-generated peptide variant
LYRFLRRLLKRFRRLLPNLNINLREKDLQKNARITYCIKKPRVLR

SEQ ID NO: 5778 - protein, 41 aa, Artificial Sequence
  Computer-generated peptide variant
WLKLYNKLFKYYKPLYATDAVDLKQRHSKATIRSRKRLRRA

SEQ ID NO: 5779 - protein, 20 aa, Artificial Sequence
  Computer-generated peptide variant
YFRLLRRLLKWLTKKRLFME

SEQ ID NO: 5780 - protein, 36 aa, Artificial Sequence
  Computer-generated peptide variant
RMRLYHRWWKKICKKLACAKQQWRRDYLWWLLRLLG

SEQ ID NO: 5781 - protein, 34 aa, Artificial Sequence
  Computer-generated peptide variant
KIKMFCKLYRKWRQKACNRLQLLEPWLLPLRALF

SEQ ID NO: 5782 - protein, 35 aa, Artificial Sequence
  Computer-generated peptide variant
LYKFLSRLMKKYRRWKLRAKMRCILADRAKADVLR

SEQ ID NO: 5783 - protein, 46 aa, Artificial Sequence
  Computer-generated peptide variant
FLKFFKKFIRIYKKTAVRARMAKRWACYAALLYTRGAAKRLAVRTA

SEQ ID NO: 5784 - protein, 31 aa, Artificial Sequence
  Computer-generated peptide variant
RMKLLQRFLKIFPHAILKLDRAMFYAKMRLA

SEQ ID NO: 5785 - protein, 64 aa, Artificial Sequence
  Computer-generated peptide variant
KYRLWRRFFRWIKTEKTEAVTLEAKKSLRALLGKKAHCNRYLLKVHLMVSRFYHLKLALAKYKL

SEQ ID NO: 5786 - protein, 54 aa, Artificial Sequence
  Computer-generated peptide variant
RYKILRKMMKKWHTHARCRPLLARNLDAKGLNHFALAALKPAKSQQDILKKASW

SEQ ID NO: 5787 - protein, 36 aa, Artificial Sequence
  Computer-generated peptide variant
LIKYFRKMLKFLCSKHKKCAEKMLSAAVRKNKAVAL

SEQ ID NO: 5788 - protein, 38 aa, Artificial Sequence
  Computer-generated peptide variant
RWRMLPKLLKWLPKYAFSSILQLAKNLLKLQRWAKRQW

SEQ ID NO: 5789 - protein, 34 aa, Artificial Sequence
  Computer-generated peptide variant
KFRLFCKYYRKLQSADGKHRLELAAKLIASEKKL

SEQ ID NO: 5790 - protein, 25 aa, Artificial Sequence
  Computer-generated peptide variant
KLKFLCKIFRYMQNACKRALRPLRI

SEQ ID NO: 5791 - protein, 94 aa, Artificial Sequence
  Computer-generated peptide variant
KFKMICKMLKKMKTCQLRRLKKRPGPNKRRAEAFPATMFKAPRDAWKLCPKRWLEERALAKQMAAKKPALHLIMLAFRRCAKKKLCAGGLKQQA

SEQ ID NO: 5792 - protein, 35 aa, Artificial Sequence
  Computer-generated peptide variant
RIRFLKKLWRRLRRRLKPLHALAHIAAAEFCRAKI

SEQ ID NO: 5793 - protein, 38 aa, Artificial Sequence
  Computer-generated peptide variant
KFRLWKKLLRFMRRALDAMSAAMHGMKLHRGRINVNAL

SEQ ID NO: 5794 - protein, 47 aa, Artificial Sequence
  Computer-generated peptide variant
KLKLIKRMYKWFKRRACKLYLGAFKMRVMAILYSPDNWEAALKELRK

SEQ ID NO: 5795 - protein, 24 aa, Artificial Sequence
  Computer-generated peptide variant
FMRLLKRLLRRISTLKLQRIKHSQ

SEQ ID NO: 5796 - protein, 55 aa, Artificial Sequence
  Computer-generated peptide variant
RYKYLPRLMRKLPRRAKNGHQCALKTTRGYRHKRALAAYAGAKAYVQAIAMLIRE

SEQ ID NO: 5797 - protein, 60 aa, Artificial Sequence
  Computer-generated peptide variant
LFRLLRRIFKIMKRCLTRARRLAARLAGAPRKRAKMMRFVEKALLHVQKVSIAAKMKEII

SEQ ID NO: 5798 - protein, 31 aa, Artificial Sequence
  Computer-generated peptide variant
KLKLIKKFFKIIRNLVEHYRSRLAARCKVAA

SEQ ID NO: 5799 - protein, 32 aa, Artificial Sequence
  Computer-generated peptide variant
KFRIIKRLYKMLNCRLEARAKRKCLLRAMAGS

SEQ ID NO: 5800 - protein, 45 aa, Artificial Sequence
  Computer-generated peptide variant
LFRLMTRFLRKLRPAFEMSKKDMRAHRAYDKGLKATLKRKERAKL

SEQ ID NO: 5801 - protein, 36 aa, Artificial Sequence
  Computer-generated peptide variant
RLKMLSKLFKKLNKYNRKASSCRKYTRFLSFADLQA

SEQ ID NO: 5802 - protein, 33 aa, Artificial Sequence
  Computer-generated peptide variant
RLRLLSKLFKRWRKQPRAWLGLSLDAAQDARLK

SEQ ID NO: 5803 - protein, 43 aa, Artificial Sequence
  Computer-generated peptide variant
KLKYYPRMLRKLKQIQALAFLKYNSCRKRKRWAQNRAATHAYR

SEQ ID NO: 5804 - protein, 39 aa, Artificial Sequence
  Computer-generated peptide variant
YFKFMSRLIRLLNSRLKYMLRRRYKAHRALANCAAERAW

SEQ ID NO: 5805 - protein, 48 aa, Artificial Sequence
  Computer-generated peptide variant
KMKFFKRFMRLLNKLLHNRYKSNLASSWRTSADARKPMAMLLALFLAR

SEQ ID NO: 5806 - protein, 38 aa, Artificial Sequence
  Computer-generated peptide variant
RWRYFNRLFKFLRNLAGCCALTFIRLKHPLRRVRLAAG

SEQ ID NO: 5807 - protein, 78 aa, Artificial Sequence
  Computer-generated peptide variant
KIKMMKKMFRRFSTPWRARAARSERGWLAVLQRKAPLPRFGLLFKWIRKCWLARLRRYLRAREDPPARHSRRLLTAQA

SEQ ID NO: 5808 - protein, 25 aa, Artificial Sequence
  Computer-generated peptide variant
YLKFWKKFLKLIQTEGQAAALSRRL

SEQ ID NO: 5809 - protein, 29 aa, Artificial Sequence
  Computer-generated peptide variant
WYKLLKRLWRKIRKALAARLARYKKSLWR

SEQ ID NO: 5810 - protein, 21 aa, Artificial Sequence
  Computer-generated peptide variant
FLKFLRRLFRKLKRHGALFDA

SEQ ID NO: 5811 - protein, 40 aa, Artificial Sequence
  Computer-generated peptide variant
KMKLLQRLMKKWRKALACLWELLHMKKRSKCAVTAQKIAL

SEQ ID NO: 5812 - protein, 87 aa, Artificial Sequence
  Computer-generated peptide variant
LFKFFRRLYRFFKRERLRAGLASRHITKNCKIAMKLAANNAMPARPEKKLMRQCAQMRKIARWSGWAAKKHCELRKAAHSADALRKE

SEQ ID NO: 5813 - protein, 31 aa, Artificial Sequence
  Computer-generated peptide variant
LFKWMRRFLRLWRRILKAELMKDRAMLSTDA

SEQ ID NO: 5814 - protein, 22 aa, Artificial Sequence
  Computer-generated peptide variant
RIRLMKKLWRKMNKAAKASLAV

SEQ ID NO: 5815 - protein, 33 aa, Artificial Sequence
  Computer-generated peptide variant
RLRYLRRWLKRWSNDMLKKLLRGGLRIALERKL

SEQ ID NO: 5816 - protein, 81 aa, Artificial Sequence
  Computer-generated peptide variant
WLKMLKKLFRKLKHKLLKPVANARLCYLQNLQDRRRDTRWWCKLDFACYALKAARLHMHKGVKLHGGNSRQLAALLVLLLY

SEQ ID NO: 5817 - protein, 47 aa, Artificial Sequence
  Computer-generated peptide variant
IMRFFRRLFRLLKRNKVRCLLLAKNKEANMQRFDFLLACMEAKARSW

SEQ ID NO: 5818 - protein, 52 aa, Artificial Sequence
  Computer-generated peptide variant
RMRMYRRFYRMLKRAMARLAEAKLRTSDHRHFLRPQGWAVAALTKRKANLVV

SEQ ID NO: 5819 - protein, 29 aa, Artificial Sequence
  Computer-generated peptide variant
IWRILRRLMKKLKRRYQSLMALRGCALAP

SEQ ID NO: 5820 - protein, 32 aa, Artificial Sequence
  Computer-generated peptide variant
FMRLLKRLFKRMCKYEKRKLLWKAMQKLLAEF

SEQ ID NO: 5821 - protein, 27 aa, Artificial Sequence
  Computer-generated peptide variant
LFRLLHRIFKFIRKLRHAMKYLRACDE

SEQ ID NO: 5822 - protein, 40 aa, Artificial Sequence
  Computer-generated peptide variant
ILRLWRKIWKKWRRQMLYKGALIKMRFPRAKFLAWEVAQL

SEQ ID NO: 5823 - protein, 32 aa, Artificial Sequence
  Computer-generated peptide variant
LLRFFRKILRKIHRKLVKYLLLQGRWHGLKLP

SEQ ID NO: 5824 - protein, 37 aa, Artificial Sequence
  Computer-generated peptide variant
KLRLLKRFWKLLKQFTAAIRRHGWKPFRGGNLYKAYK

SEQ ID NO: 5825 - protein, 46 aa, Artificial Sequence
  Computer-generated peptide variant
RLKILTRLLRRIKKNLLKLLLQVLVAHLNLGAIKAMRSFRYRNHPL

SEQ ID NO: 5826 - protein, 99 aa, Artificial Sequence
  Computer-generated peptide variant
RLKIFKRLFRFLKTFLPQLRADKDRARGRDYKSAALGCLQSGACWWCCRRALKGHLRSWSATKHKAKRSWKCRKALVLRMLLKDARHTAYRGALRKKPA

SEQ ID NO: 5827 - protein, 78 aa, Artificial Sequence
  Computer-generated peptide variant
KLRLFCRMLRKYRSAKISANCTWVSYCRVYAPLLLFSDRENKKAMLLKRPDAHRKGPREALYLRRAKKGRPLAKADYK

SEQ ID NO: 5828 - protein, 67 aa, Artificial Sequence
  Computer-generated peptide variant
RIKWFRRFWKKIRQGLALHRAFLFGRKWRCLLKYRLVTNLFSLLNRQSKRFTMLKRLATNALLLLKK

SEQ ID NO: 5829 - protein, 29 aa, Artificial Sequence
  Computer-generated peptide variant
LIKYYRKYWKRLRKAARTLSAFAAISTNY

SEQ ID NO: 5830 - protein, 84 aa, Artificial Sequence
  Computer-generated peptide variant
KMKYWNKFYRRLPRAAARRHPAALWRMMWALHLRTAYKLVLSILDRRRQGGALFKEARQAIGRAKFKRNATAAHIYAALAAMIK

SEQ ID NO: 5831 - protein, 31 aa, Artificial Sequence
  Computer-generated peptide variant
KMKFLHRILKMWRKCKKTAACACQFLLEKKL

SEQ ID NO: 5832 - protein, 45 aa, Artificial Sequence
  Computer-generated peptide variant
KYKMMRRLLRRIPRAKCAYALPGETYTAGKPKAWRKRAMAARNCI

SEQ ID NO: 5833 - protein, 28 aa, Artificial Sequence
  Computer-generated peptide variant
RLRLFTRFLRKLKRAADWAQKRKASRAC

SEQ ID NO: 5834 - protein, 76 aa, Artificial Sequence
  Computer-generated peptide variant
RLKLWKKLMRRLRKHHQPKATRLPSVLRAASLHEDIAFSCAGKVGNWAAKRLFRDPNEKKVAAPARWRCVRKKGRR

SEQ ID NO: 5835 - protein, 45 aa, Artificial Sequence
  Computer-generated peptide variant
KFRIMRRILKRFNKKAKLLEKQWPLGLPAFGKRSLENKLWALASP

SEQ ID NO: 5836 - protein, 29 aa, Artificial Sequence
  Computer-generated peptide variant
LYRLITRWLRKLTPCNLKWRATAWLRSRR

SEQ ID NO: 5837 - protein, 37 aa, Artificial Sequence
  Computer-generated peptide variant
KFRWLRKILKFLRRAMGAYSRNGRAKRILHLASMKWY

SEQ ID NO: 5838 - protein, 42 aa, Artificial Sequence
  Computer-generated peptide variant
RFRLLKRLLRWIPRALNAAWHKRLRLRSVCRSAAYGKYKYLV

SEQ ID NO: 5839 - protein, 72 aa, Artificial Sequence
  Computer-generated peptide variant
MLKLLNRFLRRFRKLTCLWLVACPRAYAKQAMHKNIYGARHLKPALGKWKTKIHRMVALALYQAEKAEYRAL

SEQ ID NO: 5840 - protein, 90 aa, Artificial Sequence
  Computer-generated peptide variant
ILKLFKKFFRKIKKADYDLALEVKRKLRNNWACRKLKNAALAKAKPCLRTLRMGRKKNYPTKTAGGAPLLEKAHLRLANLLLKAAIDRLR

SEQ ID NO: 5841 - protein, 43 aa, Artificial Sequence
  Computer-generated peptide variant
KLKLLRKLLKYIRKVQLAAKRTKAASLRLFWADFQIFYVEHRM

SEQ ID NO: 5842 - protein, 94 aa, Artificial Sequence
  Computer-generated peptide variant
IFKLFRRLLRRWRKAQYAKFCGVQLTMAFAHHLKWKLAFRLKLLARAKAKWVFREGDQPQYLAKKWARQFRRAKGLKRKRHLMAARAAYRKVMK

SEQ ID NO: 5843 - protein, 54 aa, Artificial Sequence
  Computer-generated peptide variant
KMRLICRLWKRWRRSKLMHCGPAGALSLKLERARYAEAKGLAKEDQALTRWKMA

SEQ ID NO: 5844 - protein, 36 aa, Artificial Sequence
  Computer-generated peptide variant
RYKLWNRILKFFKPGRRRKADAAWLRKLLLIKHMQW

SEQ ID NO: 5845 - protein, 20 aa, Artificial Sequence
  Computer-generated peptide variant
RYKLLKKLFRLLPKQLIDAD

SEQ ID NO: 5846 - protein, 21 aa, Artificial Sequence
  Computer-generated peptide variant
MWKILKRLLKRMRKWCALTNN

SEQ ID NO: 5847 - protein, 43 aa, Artificial Sequence
  Computer-generated peptide variant
RMKLMTKLLKMLRRNAARHDKLKNKRTAKKPARDERARPAAGE

SEQ ID NO: 5848 - protein, 80 aa, Artificial Sequence
  Computer-generated peptide variant
ILKFMCKMMRKWKKIALRRHEQLKKLLFLGLGKRHKALHTPVLRVDILFWLTRLRLLRRKMDAKKLWYVKCADRRKGKQL

SEQ ID NO: 5849 - protein, 23 aa, Artificial Sequence
  Computer-generated peptide variant
KLKLLRRFLRWFHKIPEAARCYL

SEQ ID NO: 5850 - protein, 40 aa, Artificial Sequence
  Computer-generated peptide variant
RFKLLRKMFRKIRSAQDCKAPMAAAAKAAYIARPAEKPKF

SEQ ID NO: 5851 - protein, 26 aa, Artificial Sequence
  Computer-generated peptide variant
RLRFMRKYLRRMRTLARGTYEWCAAL

SEQ ID NO: 5852 - protein, 36 aa, Artificial Sequence
  Computer-generated peptide variant
LLKIWKRFFRWLKRALWFQYAFRAQVAARWSLLYKR

SEQ ID NO: 5853 - protein, 98 aa, Artificial Sequence
  Computer-generated peptide variant
LFRMLTRFFKKWKRLCLRNILKVAASLKKPKGVKVENYLLCACCEILQELLIAAKLKKCIAKCRRLLCQMMAPKNKKISEKRLFKLFPHKKLAAIKAA

SEQ ID NO: 5854 - protein, 44 aa, Artificial Sequence
  Computer-generated peptide variant
LWRILRKLLKFLKCVAKQKAVAAAGAARVSQTKRAEARVVRVLK

SEQ ID NO: 5855 - protein, 43 aa, Artificial Sequence
  Computer-generated peptide variant
RLRFLSRLYKWWRKSHKRLELHAKAVTRARLAACSHIREAAKR

SEQ ID NO: 5856 - protein, 71 aa, Artificial Sequence
  Computer-generated peptide variant
FYKLYKRFFRLWKRARDGHKKWALAKMIAALYSFGRYLLQAKLAAAQKKDKLGEKHLDAKARAGWVYKAKE

SEQ ID NO: 5857 - protein, 40 aa, Artificial Sequence
  Computer-generated peptide variant
RLRIFRRIMKLLNKHFMPKVRDYALWREAFLARKLARLIY

SEQ ID NO: 5858 - protein, 63 aa, Artificial Sequence
  Computer-generated peptide variant
KYKYLKKYYRRFRPLRTWKRATSEIKKDWCKKNAAARHRLAAQLWNKALKVWKLVILRANQAT

SEQ ID NO: 5859 - protein, 34 aa, Artificial Sequence
  Computer-generated peptide variant
MMRLIHRWLKWMRRFQASPALFLMAMEKARARRK

SEQ ID NO: 5860 - protein, 69 aa, Artificial Sequence
  Computer-generated peptide variant
MFKLLNRLWRMLKRNAFIEWVKVAAVKAPVKKAAKSAEHLAALLFLFLHCWKLKAKMSRAKRLKADEKY

SEQ ID NO: 5861 - protein, 35 aa, Artificial Sequence
  Computer-generated peptide variant
KLRLLRKILRFFRQVAAALPKRRMLMEQWRLRCFD

SEQ ID NO: 5862 - protein, 64 aa, Artificial Sequence
  Computer-generated peptide variant
RLRMWNKMFRFLSRDRKNAQKALGWMRLRRLALMEGASGRGGSKWTAKLTKKRRCLRASMKLRD

SEQ ID NO: 5863 - protein, 86 aa, Artificial Sequence
  Computer-generated peptide variant
YFRWFRKLLKKLSHSEVLPFKALQNWLLAPHKLLALPLKKVKKRAAYELMYEAKVRLMRRQAKKRSNKPVLCRAINNECHRRQAAL

SEQ ID NO: 5864 - protein, 32 aa, Artificial Sequence
  Computer-generated peptide variant
RWKIWRRLWRKINKRPPNALLARAALALRMKT

SEQ ID NO: 5865 - protein, 58 aa, Artificial Sequence
  Computer-generated peptide variant
RLKYLKRFLRLLTHICMDYIALCCKLKIKKKIRILNMRRCDLEKHKRALATLCVIKKY

SEQ ID NO: 5866 - protein, 27 aa, Artificial Sequence
  Computer-generated peptide variant
WWKLMTRLLKWFRQNRALFLCRLARKK

SEQ ID NO: 5867 - protein, 36 aa, Artificial Sequence
  Computer-generated peptide variant
LFRLMSKFWKLFPKAYHLLLHKELKGLRAKCFPKFL

SEQ ID NO: 5868 - protein, 38 aa, Artificial Sequence
  Computer-generated peptide variant
KWRLFRKWFKRWRRLKHLLRLERAMLFKPLGLCLAQAY

SEQ ID NO: 5869 - protein, 60 aa, Artificial Sequence
  Computer-generated peptide variant
LLKLYKRMLKKITTDEAREELAGLRKANQAVACMKRGKIGMADLRSAKSAKMLQMNRMAL

SEQ ID NO: 5870 - protein, 66 aa, Artificial Sequence
  Computer-generated peptide variant
WFKFFHRLMRMMRTYTARRKLRLPLRKFLRRKKAKKLSLCKSAAYKKMLQQRAIADGAKNFHLLRL

SEQ ID NO: 5871 - protein, 32 aa, Artificial Sequence
  Computer-generated peptide variant
KYRMLKRLLRKYCKMGEKASSPRTPPLLTLAK

SEQ ID NO: 5872 - protein, 26 aa, Artificial Sequence
  Computer-generated peptide variant
KMKILKRLFKKFKKQLAPQQADSLPA

SEQ ID NO: 5873 - protein, 44 aa, Artificial Sequence
  Computer-generated peptide variant
YLRLFRKLLKILPSYLKGAQRAKEKKIICYKLAYLTGRLSLRNK

SEQ ID NO: 5874 - protein, 54 aa, Artificial Sequence
  Computer-generated peptide variant
FLKFFCKYLRMLKKCMLLLRTLEWYRAIPLRAEKPYCHRGLKAAKIPWKARADR

SEQ ID NO: 5875 - protein, 48 aa, Artificial Sequence
  Computer-generated peptide variant
KFRLLQRWFKWFKKRFKRKAADCLINLAMKRALHILVSDVRKWARTRL

SEQ ID NO: 5876 - protein, 29 aa, Artificial Sequence
  Computer-generated peptide variant
KLKFLSRFMRRWSPLLHRLRPAFFQLALE

SEQ ID NO: 5877 - protein, 27 aa, Artificial Sequence
  Computer-generated peptide variant
LIRFLKRFWKKLQTAKFHYALEKSPLR

SEQ ID NO: 5878 - protein, 49 aa, Artificial Sequence
  Computer-generated peptide variant
RFRFMQKLLRLWRKAAELAANALRKDFQKQAVPYFYTIMGRKFKNKKAL

SEQ ID NO: 5879 - protein, 84 aa, Artificial Sequence
  Computer-generated peptide variant
FYRFFCKFLRKLCRAAIAAGKHTKARAKHAARHSKRFLQGQKHYRELTLFARAKGLRTKRASPALKALKQNERNFIANFAILLA

SEQ ID NO: 5880 - protein, 26 aa, Artificial Sequence
  Computer-generated peptide variant
LFKFLHKWLKRFKRNGSLAKLAKIFH

SEQ ID NO: 5881 - protein, 40 aa, Artificial Sequence
  Computer-generated peptide variant
RIKLLKKMFKKYKTPRARLPFALHHLAYARWLCTQVWLYR

SEQ ID NO: 5882 - protein, 24 aa, Artificial Sequence
  Computer-generated peptide variant
FLKLFQKFFRLLTQKALHKAKIKF

SEQ ID NO: 5883 - protein, 56 aa, Artificial Sequence
  Computer-generated peptide variant
KFRFLRKLWKKYKSYAKKWKLAAQAIFCLAWLYARAALRQVIDANCGDALEKLGKE

SEQ ID NO: 5884 - protein, 60 aa, Artificial Sequence
  Computer-generated peptide variant
LIRLLCKLIKKYRCLQTSEARQRRLYVYAKYALLAAHKNLRLLMRMRYGDKCKRCFNRFA

SEQ ID NO: 5885 - protein, 24 aa, Artificial Sequence
  Computer-generated peptide variant
RLKLYHRLLKYYKKILKYNKLFDT

SEQ ID NO: 5886 - protein, 24 aa, Artificial Sequence
  Computer-generated peptide variant
LLRWMKKLFRKLNKAPCRLAMKKE

SEQ ID NO: 5887 - protein, 28 aa, Artificial Sequence
  Computer-generated peptide variant
KFKWLQRLLKKYRKLVRCWMYAQRALPA

SEQ ID NO: 5888 - protein, 25 aa, Artificial Sequence
  Computer-generated peptide variant
KLKILQRLMRFFRRAVIANNAALRH

SEQ ID NO: 5889 - protein, 61 aa, Artificial Sequence
  Computer-generated peptide variant
LYRFFCRYLRLFRKRAYAVSLRRRARAHNALGLALAIDSRKMAWRHRHKANKEILDRRLHP

SEQ ID NO: 5890 - protein, 36 aa, Artificial Sequence
  Computer-generated peptide variant
RLKYMTKWLRMYNKKWLGKALRIKIALYALKLTSAF

SEQ ID NO: 5891 - protein, 89 aa, Artificial Sequence
  Computer-generated peptide variant
RIRFLKRMWRRWRQIAQSLRAEIAKLKIKSETYCLQKMKAMTAERLLILLFAINSNALALWTEKLARKITKSAAKPARTKCALGAYHAR

SEQ ID NO: 5892 - protein, 33 aa, Artificial Sequence
  Computer-generated peptide variant
KLKFLRKIMKRFTRSLYKRFLPQLLSLLIVYRK

SEQ ID NO: 5893 - protein, 25 aa, Artificial Sequence
  Computer-generated peptide variant
RLKWLRKWLRKFCPAQCMVRAHLLY

SEQ ID NO: 5894 - protein, 41 aa, Artificial Sequence
  Computer-generated peptide variant
MIRYMKRLMKYYSKGAAALNGCRKRRLLTLARVRCKLGKRL

SEQ ID NO: 5895 - protein, 56 aa, Artificial Sequence
  Computer-generated peptide variant
RLRLWRRWFRILSKWHYESKFRRLKAALSEAVNRAHLRANTMKRLRLYADVWKKKQ

SEQ ID NO: 5896 - protein, 69 aa, Artificial Sequence
  Computer-generated peptide variant
RFKWYRRIYRRMRTRSAKAAALKLKWRPQLLVKAANGHAVAHKRCLHLAQCCELRKPGELHRKLWFVAK

SEQ ID NO: 5897 - protein, 28 aa, Artificial Sequence
  Computer-generated peptide variant
FIRFIKKFLRFLRRAAIKSLPANLKPRD

SEQ ID NO: 5898 - protein, 54 aa, Artificial Sequence
  Computer-generated peptide variant
KFRWWCRFLKMIRNRGRRRLLRLAAFYALTNRMSKHLWYARARDQMRRDAKAPR

SEQ ID NO: 5899 - protein, 23 aa, Artificial Sequence
  Computer-generated peptide variant
RLRFLTRFLRWLRTSKSEIRCAA

SEQ ID NO: 5900 - protein, 44 aa, Artificial Sequence
  Computer-generated peptide variant
KFRYFQKFLKRLCKMEESLKALAKRACWRHDKIQAKNAAARAWA

SEQ ID NO: 5901 - protein, 54 aa, Artificial Sequence
  Computer-generated peptide variant
KLRLFRRLYKKICRMYPARPLGKREIHCKLKAMLLKPGHKRLALRKADHKAFVL

SEQ ID NO: 5902 - protein, 67 aa, Artificial Sequence
  Computer-generated peptide variant
RLRFMNRMYRRFRKGVRRAFIARLILNWALIRVASLMYATATAFKAKRHLLWAKITAKARPVRKKKK

SEQ ID NO: 5903 - protein, 92 aa, Artificial Sequence
  Computer-generated peptide variant
KLRYLKKLLRKIKRGQGKQGSFAALNAALKIKFFGLVKVLKVSADAATLLPWRVARYKARTYAERFKLENFKLEPMATKFLWAGELLARDLP

SEQ ID NO: 5904 - protein, 37 aa, Artificial Sequence
  Computer-generated peptide variant
RLKLWTRWLRLMRKRLIEGLKLLLVKNAGTFRGIWAK

SEQ ID NO: 5905 - protein, 25 aa, Artificial Sequence
  Computer-generated peptide variant
RLKLMTKYWRLMNKLALKSEKVPFK

SEQ ID NO: 5906 - protein, 40 aa, Artificial Sequence
  Computer-generated peptide variant
KYKFLRRLFRWLKRLQDRRAPMIWALSAKRERSNSLLILK

SEQ ID NO: 5907 - protein, 51 aa, Artificial Sequence
  Computer-generated peptide variant
LFRWLCRFMKWWTRRAKALILAPTASRTRLLAILAAIGARANVKVSAKKER

SEQ ID NO: 5908 - protein, 34 aa, Artificial Sequence
  Computer-generated peptide variant
RIKYLTKMLRKFHTASKAYLIYKQLDAAASKLNL

SEQ ID NO: 5909 - protein, 31 aa, Artificial Sequence
  Computer-generated peptide variant
KLKFLHKLIRRLCHRRSKIMRVAHAAFAHAK

SEQ ID NO: 5910 - protein, 30 aa, Artificial Sequence
  Computer-generated peptide variant
LWKLYHRLIRFLCQVRRIGARALLKRHRLG

SEQ ID NO: 5911 - protein, 40 aa, Artificial Sequence
  Computer-generated peptide variant
KFKFYKKLMKFWRKLNAKARAKCPNYLPLQKRTQALRKAI

SEQ ID NO: 5912 - protein, 54 aa, Artificial Sequence
  Computer-generated peptide variant
YFRLWRRLLRRLKPQDAEPANGNVRARKRFVLLLTWCLRALMFCYAAKYRKFYA

SEQ ID NO: 5913 - protein, 34 aa, Artificial Sequence
  Computer-generated peptide variant
LLKLLRKYLRLFPKRGISKIKRKLAELLTPYYAD

SEQ ID NO: 5914 - protein, 24 aa, Artificial Sequence
  Computer-generated peptide variant
KIKILTRFLRLLPNIEAAAQRAKM

SEQ ID NO: 5915 - protein, 47 aa, Artificial Sequence
  Computer-generated peptide variant
RFRLLKRYIRLLCKLRALAFYHLRRLLKLFLMAYLLCMSIRKWCKKS

SEQ ID NO: 5916 - protein, 42 aa, Artificial Sequence
  Computer-generated peptide variant
KFKWITKLIKKFRHKRLWLLTNNRAKQERRMHALMNLKAKLM

SEQ ID NO: 5917 - protein, 23 aa, Artificial Sequence
  Computer-generated peptide variant
FFRLMRKLMRRLQKAEPHAELIR

SEQ ID NO: 5918 - protein, 51 aa, Artificial Sequence
  Computer-generated peptide variant
LYKWYRKLYKFLQKPRPLDGACVHARGKKDLYHKRLWKSIRAAKAKRWGLL

SEQ ID NO: 5919 - protein, 65 aa, Artificial Sequence
  Computer-generated peptide variant
FLKLFKKLFKKYCRRRPLLDKACFNTLLDKVTRKLASADNPYLGRGANLRRCTFRMARFRYLCKK

SEQ ID NO: 5920 - protein, 50 aa, Artificial Sequence
  Computer-generated peptide variant
WLRLFKKMYRKLHNNLDKRGAAFCDLKVALSKMTMKPATCKKACKAYKAA

SEQ ID NO: 5921 - protein, 66 aa, Artificial Sequence
  Computer-generated peptide variant
LFRLFPKYWKWLRKYTPKLIMQTGHKRIAKQTKDLRRAPSLDKAHRAARERELKLKYYEALLRYAR

SEQ ID NO: 5922 - protein, 27 aa, Artificial Sequence
  Computer-generated peptide variant
KYKILPRMLRRLKRGLWHLSALQQLAK

SEQ ID NO: 5923 - protein, 49 aa, Artificial Sequence
  Computer-generated peptide variant
RLRLFQRMWKRIPKQHHLAYQRILSTRSKAKALALVRKYAKANTLDILY

SEQ ID NO: 5924 - protein, 73 aa, Artificial Sequence
  Computer-generated peptide variant
KWRWMKRIFRRMSKNVYARLNSLILAARLSLRKKHAQGPTLLQHKWKIAAFLKRHACLRRRATMKAWGALAQN

SEQ ID NO: 5925 - protein, 43 aa, Artificial Sequence
  Computer-generated peptide variant
FIKILRRWLKLITSARAGKHKKLALWMMALARLLYEIAKNRCK

SEQ ID NO: 5926 - protein, 21 aa, Artificial Sequence
  Computer-generated peptide variant
MWRFWKKFLKLLPRHLNQKKA

SEQ ID NO: 5927 - protein, 22 aa, Artificial Sequence
  Computer-generated peptide variant
IFKMLNKWLKKLRRAAGFSKLP

SEQ ID NO: 5928 - protein, 29 aa, Artificial Sequence
  Computer-generated peptide variant
RYKLLRRLWRKLNKLDKKFLLGHTTWPDY

SEQ ID NO: 5929 - protein, 53 aa, Artificial Sequence
  Computer-generated peptide variant
RFKLLKKLIKRFTTLRNVLLKLKGNGLKTRAAQNAALAVIWRRAKIMPHLWKR

SEQ ID NO: 5930 - protein, 27 aa, Artificial Sequence
  Computer-generated peptide variant
LFRWYSKLLRRICRAHHRGAMRLRLQR

SEQ ID NO: 5931 - protein, 60 aa, Artificial Sequence
  Computer-generated peptide variant
KMRFFKKWMRRMNHKPRMLKLAAAYRVKVLSAAVADMALASAKARVMPVVWTKLGAKRRA

SEQ ID NO: 5932 - protein, 28 aa, Artificial Sequence
  Computer-generated peptide variant
YLRILKRLLRWLHRGDIQAKNQKHRALC

SEQ ID NO: 5933 - protein, 37 aa, Artificial Sequence
  Computer-generated peptide variant
YLRWWKKLIKLLRKLTDKDRWRYTLAGILKNRKYLPC

SEQ ID NO: 5934 - protein, 65 aa, Artificial Sequence
  Computer-generated peptide variant
LYRWLRKLLRKLKPQMWLRAVPTKLKFGKCLKHAPWSAKLMVCKTKAALMLKSKMWKPQHMASRK

SEQ ID NO: 5935 - protein, 31 aa, Artificial Sequence
  Computer-generated peptide variant
KWKLLRKLYKRLKREWCTADFLFYLLCLRLA

SEQ ID NO: 5936 - protein, 34 aa, Artificial Sequence
  Computer-generated peptide variant
MWKLWKRLFKFLQPRPLDIFAFHKLAACAAKRRL

SEQ ID NO: 5937 - protein, 37 aa, Artificial Sequence
  Computer-generated peptide variant
MLKMYRRYFKLWCRARWCAARMQLAKGYANRHRLGLR

SEQ ID NO: 5938 - protein, 29 aa, Artificial Sequence
  Computer-generated peptide variant
RYRFLPRFLRRFRCAVSLAATNWKALKQK

SEQ ID NO: 5939 - protein, 41 aa, Artificial Sequence
  Computer-generated peptide variant
RIKLFKKIIKMYKCYQAHCLLKLAAAMIRLKCKCGRYSRLR

SEQ ID NO: 5940 - protein, 26 aa, Artificial Sequence
  Computer-generated peptide variant
RLRFLKRLWKKLKRCAVPTEYWYAAV

SEQ ID NO: 5941 - protein, 54 aa, Artificial Sequence
  Computer-generated peptide variant
WLRWIQRLWRKLNKLYLGVALKKLFYKKRSARKEWNEKCLLAVFPAIPQRRLNK

SEQ ID NO: 5942 - protein, 37 aa, Artificial Sequence
  Computer-generated peptide variant
RFKWLRRLLRRLCRDNWDKQAACNAHKHRYLARKAFH

SEQ ID NO: 5943 - protein, 34 aa, Artificial Sequence
  Computer-generated peptide variant
YLKFLRRWMKKWKQKKRLALLLFHMADRQLKLAA

SEQ ID NO: 5944 - protein, 27 aa, Artificial Sequence
  Computer-generated peptide variant
RLKLLQKLFRLLCRCIKEKLMQYQNAW

SEQ ID NO: 5945 - protein, 39 aa, Artificial Sequence
  Computer-generated peptide variant
RFRLFKKLLKKLKRMSLRMQRNRKLYLYCANARANWLGE

SEQ ID NO: 5946 - protein, 28 aa, Artificial Sequence
  Computer-generated peptide variant
FLKYFSKLFRLFRKRLCFYCAKNRLASR

SEQ ID NO: 5947 - protein, 29 aa, Artificial Sequence
  Computer-generated peptide variant
KLRLFHKLLKRLKHLDRMSTLRAAVSEQK

SEQ ID NO: 5948 - protein, 22 aa, Artificial Sequence
  Computer-generated peptide variant
RFKFLRKLLKRLNRMPCYIAAR

SEQ ID NO: 5949 - protein, 63 aa, Artificial Sequence
  Computer-generated peptide variant
FLRFLRRFLRWLRKCAAADQRSEARLGLLLRELDAIARYARWCRGYRVNQAYRLRTSCHVLLQ

SEQ ID NO: 5950 - protein, 20 aa, Artificial Sequence
  Computer-generated peptide variant
KLRFLCRLYKWLSKYWLFKK

SEQ ID NO: 5951 - protein, 38 aa, Artificial Sequence
  Computer-generated peptide variant
LLKYMHRWLKRLQKHIITKRAAFPLKGQLSKRKAAMAF

SEQ ID NO: 5952 - protein, 25 aa, Artificial Sequence
  Computer-generated peptide variant
MFRLLKRFYKWLRRLLLGRRTRAAI

SEQ ID NO: 5953 - protein, 49 aa, Artificial Sequence
  Computer-generated peptide variant
RLRLFRRLLRKFPRLECLFPKGAKYILRTQWQTDMAALAKVKKLETLGS

SEQ ID NO: 5954 - protein, 38 aa, Artificial Sequence
  Computer-generated peptide variant
RLKLLCKLYKKIRNSIAMRIAMLRCLFSDHAGLRRTKQ

SEQ ID NO: 5955 - protein, 36 aa, Artificial Sequence
  Computer-generated peptide variant
KLRILQRFMRLLRKCLIDQEVARYCPALKLPRGHKR

SEQ ID NO: 5956 - protein, 43 aa, Artificial Sequence
  Computer-generated peptide variant
RWRFLRKIFRKFSRKAALDAYRAIYASIKLKLRLARKTYAYMW

SEQ ID NO: 5957 - protein, 27 aa, Artificial Sequence
  Computer-generated peptide variant
KLKYLSRFLKFLNKRALPSMFKMDRAA

SEQ ID NO: 5958 - protein, 63 aa, Artificial Sequence
  Computer-generated peptide variant
RMRYLKKMFKKLNCKWRLLWRRLLRADAAAVQRRIRTDEYHPTVRELIAARELKLGKRAMLLN

SEQ ID NO: 5959 - protein, 58 aa, Artificial Sequence
  Computer-generated peptide variant
IWRLFQRILKLMRKLCNIIKRVQFFPRMVRAAKLLPACAYRGTRRIKAFRLLRKELAR

SEQ ID NO: 5960 - protein, 21 aa, Artificial Sequence
  Computer-generated peptide variant
KLKLMRRLYKLLRHCGKNANW

SEQ ID NO: 5961 - protein, 74 aa, Artificial Sequence
  Computer-generated peptide variant
FIKIYRKMLRFLTPRLYKARLDAVGAIKAKLRRRMGRLKWNIPHLLRNYLHRNWRLLKARHKLSDMDRIIQKKK

SEQ ID NO: 5962 - protein, 76 aa, Artificial Sequence
  Computer-generated peptide variant
LYKLWSKFLKLLRRLVLRKAQAKFCTLGTKHLKTSKMTMLERCKCRRTRGLLASAAHKERMMKAHAWKELTELALQ

SEQ ID NO: 5963 - protein, 33 aa, Artificial Sequence
  Computer-generated peptide variant
RIRMLTRWLKKLRRRTAAKYYARLRATSKWAIT

SEQ ID NO: 5964 - protein, 40 aa, Artificial Sequence
  Computer-generated peptide variant
FLKILKKLFKYIQKILKQVLMQRGRKAARLAGWLALRKIV

SEQ ID NO: 5965 - protein, 40 aa, Artificial Sequence
  Computer-generated peptide variant
YYRWLRRWLRMYRKPTREKAGFKDAILLKRLLRYTARLNY

SEQ ID NO: 5966 - protein, 30 aa, Artificial Sequence
  Computer-generated peptide variant
FMRYIKKLIKLLSKAVRKATGNRWKPLSKA

SEQ ID NO: 5967 - protein, 32 aa, Artificial Sequence
  Computer-generated peptide variant
FFKLLTRLLKFMCHLLASRLQAKAKTSRAIKN

SEQ ID NO: 5968 - protein, 56 aa, Artificial Sequence
  Computer-generated peptide variant
RMKLFRRFLKLLRSHAKKRVRAKQCALVSHRDPKSKVLYMKLARPHKLWKFYYDDA

SEQ ID NO: 5969 - protein, 24 aa, Artificial Sequence
  Computer-generated peptide variant
RIRLLKKLLRKLKRCKGMQLLCAR

SEQ ID NO: 5970 - protein, 36 aa, Artificial Sequence
  Computer-generated peptide variant
RMKFFKKLWRKWTCSAFFRFALRVLAKPHAAKGAER

SEQ ID NO: 5971 - protein, 27 aa, Artificial Sequence
  Computer-generated peptide variant
WLKLYRKLYKWLRKCALWLQMRHCKIF

SEQ ID NO: 5972 - protein, 73 aa, Artificial Sequence
  Computer-generated peptide variant
FMRYLKKLFRLIQKRKKKVTKAEPMPAGAYKADTESWALNRRWALWHRRKKKKRLELSQMLFKWGAKHLILKL

SEQ ID NO: 5973 - protein, 50 aa, Artificial Sequence
  Computer-generated peptide variant
FWKLFRRFYRRLHQKLKRTTMPEPARWYWAKRKKLLALLLFMHGARASLH

SEQ ID NO: 5974 - protein, 33 aa, Artificial Sequence
  Computer-generated peptide variant
RYKYYKRYLRRLKRDKVPLALAYIEMANLLPDR

SEQ ID NO: 5975 - protein, 27 aa, Artificial Sequence
  Computer-generated peptide variant
FFKMFRKFLRKMKRTMLSQAAAGDLKL

SEQ ID NO: 5976 - protein, 21 aa, Artificial Sequence
  Computer-generated peptide variant
RWRLMQRWLKLFRNLTAYIRR

SEQ ID NO: 5977 - protein, 56 aa, Artificial Sequence
  Computer-generated peptide variant
KFKYIRRLIRYIRSLRAHLAARLLAAKKRLAMKTLRALIFLAAHRRICAAFKARKC

SEQ ID NO: 5978 - protein, 43 aa, Artificial Sequence
  Computer-generated peptide variant
LLRYLCKFLRKYRHSAGHLGAKAHLTGWEQQKKLRLLSKQRDL

SEQ ID NO: 5979 - protein, 20 aa, Artificial Sequence
  Computer-generated peptide variant
LLKIMKKFYKLLRKAEKWWE

SEQ ID NO: 5980 - protein, 70 aa, Artificial Sequence
  Computer-generated peptide variant
LLRLIRKIFRKLNKLAYMRKASVWGTSVLDLLRKNTALRWLHKLRPPKLYARETLNLKCKVKPRLYIWLK

SEQ ID NO: 5981 - protein, 67 aa, Artificial Sequence
  Computer-generated peptide variant
ILRLLSKFLRKYCKKVRVCECMIAAMALRCPRAEKKRAKGRLSVDYWPRPAYPLADLRRADARKKRS

SEQ ID NO: 5982 - protein, 30 aa, Artificial Sequence
  Computer-generated peptide variant
KLKIFPRILRLLSRRKRQCFGRILLQRNPA

SEQ ID NO: 5983 - protein, 48 aa, Artificial Sequence
  Computer-generated peptide variant
YFRYFSKIFRKIKKALALCEAKAAKEIKMPKLRDHLKMKCYLALRCRY

SEQ ID NO: 5984 - protein, 20 aa, Artificial Sequence
  Computer-generated peptide variant
RMKLLRKMFRKLSCAASCAA

SEQ ID NO: 5985 - protein, 49 aa, Artificial Sequence
  Computer-generated peptide variant
KLKYLCRILKIITTRIKAPARDQLDKCLLFCKAMKMKPAWLRGRLLKVD

SEQ ID NO: 5986 - protein, 27 aa, Artificial Sequence
  Computer-generated peptide variant
RFRWFRKLFKRLPTNALRASEDALVQR

SEQ ID NO: 5987 - protein, 33 aa, Artificial Sequence
  Computer-generated peptide variant
FIKFWRKYLKMLHCLLERRNSERLLLKATILRA

SEQ ID NO: 5988 - protein, 94 aa, Artificial Sequence
  Computer-generated peptide variant
WIKLLKRLFKKLRSHWREGETLYAKKLLCELWKLWQLLIKKLARSAKSADFVWTLKKMLMKFQKAGRLLCALRSSQNLQPRRHKKMLLASREKL

SEQ ID NO: 5989 - protein, 60 aa, Artificial Sequence
  Computer-generated peptide variant
RIRLYTKMFKFLKRRLTYWSGRDLDKIAMARKAAQGLILKKLAAKAEMFYNLTGIKKHKL

SEQ ID NO: 5990 - protein, 20 aa, Artificial Sequence
  Computer-generated peptide variant
KLKMLRRFFRKLNKALGGNP

SEQ ID NO: 5991 - protein, 46 aa, Artificial Sequence
  Computer-generated peptide variant
LLKLLTRFLKYLHRPYLMNRLRRGREAQEPLARWLMRFRLHRKCAD

SEQ ID NO: 5992 - protein, 38 aa, Artificial Sequence
  Computer-generated peptide variant
KLKFMQRLFKRWRKLTPGKIAAPFVAPAIAIQKKIKRL

SEQ ID NO: 5993 - protein, 38 aa, Artificial Sequence
  Computer-generated peptide variant
KLRFFKKFLRLWHNFAGNVRALLRWSRKAQFIKHYLRL

SEQ ID NO: 5994 - protein, 44 aa, Artificial Sequence
  Computer-generated peptide variant
FFRFWTKLLRRFKRLLTLQMTKHKRKVLWAGGYLLDAFRAALLL

SEQ ID NO: 5995 - protein, 32 aa, Artificial Sequence
  Computer-generated peptide variant
MWRLMRKLWKLLKSARDGLADCCKRRHIKAYD

SEQ ID NO: 5996 - protein, 26 aa, Artificial Sequence
  Computer-generated peptide variant
KLRLFNRLIRWLKRNLLKAADQMNHR

SEQ ID NO: 5997 - protein, 52 aa, Artificial Sequence
  Computer-generated peptide variant
RYKIFPKYYRRLKKFWHCLAACFFTRRAKLLHVQRKCALKEAMAKATRAKTK

SEQ ID NO: 5998 - protein, 21 aa, Artificial Sequence
  Computer-generated peptide variant
KMRFYTKLMKKLRRALLAGSR

SEQ ID NO: 5999 - protein, 67 aa, Artificial Sequence
  Computer-generated peptide variant
KIRLYKKYYRWFRRLARSKLRFPARKAKATWLSLAQRGWVVLAMARLLTCAARRTELTMRDMCMLWN

SEQ ID NO: 6000 - protein, 39 aa, Artificial Sequence
  Computer-generated peptide variant
KFRLLTKIIKKWQQASQQRLKLRDAAARRRLLKALQFMW

SEQ ID NO: 6001 - protein, 62 aa, Artificial Sequence
  Computer-generated peptide variant
LLRLLRRYYRLWRRTRRRFRTKCLADSIKKARKVFTDDNRDADLLRKALCLACWWLRPPWHR

SEQ ID NO: 6002 - protein, 40 aa, Artificial Sequence
  Computer-generated peptide variant
MFKLFKKFLKLLNKLKLLWSFKRNDARMKGRASAVCCHHR

SEQ ID NO: 6003 - protein, 77 aa, Artificial Sequence
  Computer-generated peptide variant
RFKLLNRLLKLMHTFTKWKLLCWMARLGTSIRLRLKNRLKNNVKLLNSHLRDLKLCHRRKLFFARNRRQLDHKPGTA

SEQ ID NO: 6004 - protein, 26 aa, Artificial Sequence
  Computer-generated peptide variant
RIRLFSKLLRLFKRKHRASHTYQAAK

SEQ ID NO: 6005 - protein, 20 aa, Artificial Sequence
  Computer-generated peptide variant
FIKILCRWIRKIPRRAAALH

SEQ ID NO: 6006 - protein, 30 aa, Artificial Sequence
  Computer-generated peptide variant
KFKLIRKWIRWIRKDDLAACKSTYALDRLA

SEQ ID NO: 6007 - protein, 22 aa, Artificial Sequence
  Computer-generated peptide variant
RLRFLRKLMRFFRKSCLAMLAK

SEQ ID NO: 6008 - protein, 50 aa, Artificial Sequence
  Computer-generated peptide variant
RLRLMRKFLKRYKQIVRWFRNPRLDVAKAAAPEKRRDIAAYGPAHCKARI

SEQ ID NO: 6009 - protein, 47 aa, Artificial Sequence
  Computer-generated peptide variant
KLKLLNKYYRRLRRANWSHQLCLATIRSERRSFYKNLCAKAAPRCCL

SEQ ID NO: 6010 - protein, 28 aa, Artificial Sequence
  Computer-generated peptide variant
KMKWLQKLLRKFTQAKCPSFAKFLRLSA

SEQ ID NO: 6011 - protein, 39 aa, Artificial Sequence
  Computer-generated peptide variant
KLKFFTRWLKRLNKRRYWCLAKARGAGNLWRFHANLKED

SEQ ID NO: 6012 - protein, 38 aa, Artificial Sequence
  Computer-generated peptide variant
KLKMFKKMLKRMHTVLKHRQGYLAARMGRRLGHLDAKP

SEQ ID NO: 6013 - protein, 68 aa, Artificial Sequence
  Computer-generated peptide variant
RLKLLHKLWKRLRKPLRARGLAKKCLESVLLQLLQDRPRHICVLMRAPRASSSHIVILKADAWATEPK

SEQ ID NO: 6014 - protein, 46 aa, Artificial Sequence
  Computer-generated peptide variant
RLRLLPKILRRYTHAPMCMLKHAMAAAIAPRKPCLRARTSPKAKTR

SEQ ID NO: 6015 - protein, 32 aa, Artificial Sequence
  Computer-generated peptide variant
KMKLLRKLLKKYRSKYKCAVAARASRTLAYLK

SEQ ID NO: 6016 - protein, 97 aa, Artificial Sequence
  Computer-generated peptide variant
RFKWFKKLLKLFTPHVYMYLATLFSKKKKARLELALRAWGWLKAYAHQLRIRDKAQRNWPLLHKLKIAYKKINKLHLLVLNIHKLHRVLAFFAVALH

SEQ ID NO: 6017 - protein, 28 aa, Artificial Sequence
  Computer-generated peptide variant
KLKLLQRLWKKYKSNAINLQTWLCLIKR

SEQ ID NO: 6018 - protein, 47 aa, Artificial Sequence
  Computer-generated peptide variant
RFRLLKKMYKKLRKEKKAQKCGGGMCLKDIWALKLTALISAARLAAG

SEQ ID NO: 6019 - protein, 46 aa, Artificial Sequence
  Computer-generated peptide variant
YMRLLHRMLKYFRRPAVRIHVKLAKQRKHLYQSKFKAAYARYLLHR

SEQ ID NO: 6020 - protein, 21 aa, Artificial Sequence
  Computer-generated peptide variant
RWRFYRKFLRLLTQLRARNEP

SEQ ID NO: 6021 - protein, 63 aa, Artificial Sequence
  Computer-generated peptide variant
KFKYLKRLYKWLKKTKHNNRCHGCLLQKCLRELLLAKALRRAILCDKTNDNLNRHHLFPRLTL

SEQ ID NO: 6022 - protein, 20 aa, Artificial Sequence
  Computer-generated peptide variant
YMKFLCKLLKFLKRKAAKQA

SEQ ID NO: 6023 - protein, 34 aa, Artificial Sequence
  Computer-generated peptide variant
YLKMFRKYLRLFNPKLKGRRAGQDVWQASARAAL

SEQ ID NO: 6024 - protein, 63 aa, Artificial Sequence
  Computer-generated peptide variant
RYRLYSRFFKLIRNSALRFSKSAATTLLRSKTAAHSFERFRKKKPALHKLTLLRLNRKPLTPI

SEQ ID NO: 6025 - protein, 27 aa, Artificial Sequence
  Computer-generated peptide variant
KWRYLTRLWKLLRHSLWRWARAAPCRP

SEQ ID NO: 6026 - protein, 29 aa, Artificial Sequence
  Computer-generated peptide variant
KFRLFRKILRRLNPNKLLGLAANPPTWWK

SEQ ID NO: 6027 - protein, 57 aa, Artificial Sequence
  Computer-generated peptide variant
KLKYWRRYFRLFNRHRYDFKLMAPKVKKEKLYLIKPDLAVAHAAANGDAAKLLARNN

SEQ ID NO: 6028 - protein, 36 aa, Artificial Sequence
  Computer-generated peptide variant
RYRILQKYMRRLRNAASELAELLKSLIAYIKGAKQY

SEQ ID NO: 6029 - protein, 27 aa, Artificial Sequence
  Computer-generated peptide variant
MWRLLRKFLKKFNKLCKLPESQKIAAR

SEQ ID NO: 6030 - protein, 64 aa, Artificial Sequence
  Computer-generated peptide variant
LLKIYSRLLKWMKRPLTARYRKLRCLAKFRRRTLAISPKECVKLPYAAPMDDQAKARAPKLQRW

SEQ ID NO: 6031 - protein, 24 aa, Artificial Sequence
  Computer-generated peptide variant
LWRMLKRIMRKIKNAWAQLPWARR

SEQ ID NO: 6032 - protein, 78 aa, Artificial Sequence
  Computer-generated peptide variant
FLRFLKRWWRWIKKLRRADNIAHNWLSAGLLPIKGCAALNFMKKKFHAKKILTAACMALKKGRKEKRKLIVLPAAAGT

SEQ ID NO: 6033 - protein, 31 aa, Artificial Sequence
  Computer-generated peptide variant
KLRLFPKLLRIYNRLRPKALLRTFVNWTRFR

SEQ ID NO: 6034 - protein, 40 aa, Artificial Sequence
  Computer-generated peptide variant
FFRIFKKILRRLKKDAGALILHMYLFTKKKACRPKTTLWK

SEQ ID NO: 6035 - protein, 58 aa, Artificial Sequence
  Computer-generated peptide variant
RLKFMRRWMKKFKCAARKLALRPAGLADIESLNDKLSKRAKYSLQPRRKLASLCCRFK

SEQ ID NO: 6036 - protein, 58 aa, Artificial Sequence
  Computer-generated peptide variant
WMKLLKRFFRRLKKMAKLKNCARRLMKGLWRDFEKVEAYRCMHRKATNTLAAFALDMS

SEQ ID NO: 6037 - protein, 29 aa, Artificial Sequence
  Computer-generated peptide variant
LWRFIKKFLRWWKSAVKKLEPEALRGVAL

SEQ ID NO: 6038 - protein, 42 aa, Artificial Sequence
  Computer-generated peptide variant
KFKWFPKILKRLRKAADKKLHPGQKLRRRALLVWKFSKLAAS

SEQ ID NO: 6039 - protein, 48 aa, Artificial Sequence
  Computer-generated peptide variant
RYRLFRKIIRRFCCCVLPLRACRKLGLAEQHLKLACKYKLFQKAKLLF

SEQ ID NO: 6040 - protein, 20 aa, Artificial Sequence
  Computer-generated peptide variant
IYKFLKRYYKKFKKAFLAYA

SEQ ID NO: 6041 - protein, 71 aa, Artificial Sequence
  Computer-generated peptide variant
RWRMLKRMFRKYKRMSKQFREFYALKPLVLRRHYAKLLDRLQAKEWKARRNAAAKKCLNMMCARQARTVLG

SEQ ID NO: 6042 - protein, 21 aa, Artificial Sequence
  Computer-generated peptide variant
LLKLFNRLLKRFHSAYSARTQ

SEQ ID NO: 6043 - protein, 36 aa, Artificial Sequence
  Computer-generated peptide variant
KLRIIPKYYRRMSRLQKLRRDWVNASNRCAAALLKR

SEQ ID NO: 6044 - protein, 51 aa, Artificial Sequence
  Computer-generated peptide variant
KLKLLNKLWKKLRRVFAFHKEILQEMKYTFAWLWEGTLARKALLARWKWWA

SEQ ID NO: 6045 - protein, 61 aa, Artificial Sequence
  Computer-generated peptide variant
RYRLFKKFFRKLRNLARSRRARADRRFLLKVGWIRDAKSKVSVAAQWKAQWRLLRGALHYT

SEQ ID NO: 6046 - protein, 43 aa, Artificial Sequence
  Computer-generated peptide variant
MMRILCRLFRRLRRLVATHVRDALRPKLFNAAYRALASQKYMC

SEQ ID NO: 6047 - protein, 24 aa, Artificial Sequence
  Computer-generated peptide variant
RFRMMKRIFRRLKKLAKIALATIL

SEQ ID NO: 6048 - protein, 40 aa, Artificial Sequence
  Computer-generated peptide variant
KMKLLQKWYRKMKQNIAAKLHLGLQAREAAKHATLRDQRF

SEQ ID NO: 6049 - protein, 20 aa, Artificial Sequence
  Computer-generated peptide variant
RYRIFKKLFRFLCRLALREG

SEQ ID NO: 6050 - protein, 26 aa, Artificial Sequence
  Computer-generated peptide variant
RFRWYTRLYKLLRRYARKKAPDLAMV

SEQ ID NO: 6051 - protein, 41 aa, Artificial Sequence
  Computer-generated peptide variant
KLRFFPRLLKLMTKKLEEHAARKFKRMWRSACPLLYCKKMM

SEQ ID NO: 6052 - protein, 49 aa, Artificial Sequence
  Computer-generated peptide variant
RWRWWHRLMKRWRKKCAKLAMLFWCVRLLQKMEPNPLFLWKLLCARAPR

SEQ ID NO: 6053 - protein, 45 aa, Artificial Sequence
  Computer-generated peptide variant
MMRMYSKYLRKFPRHRKAKLAAQCLCHTLKQPRHPFAARLLARRD

SEQ ID NO: 6054 - protein, 25 aa, Artificial Sequence
  Computer-generated peptide variant
YLKIYRKFYRRLKKDWNAILFASRL

SEQ ID NO: 6055 - protein, 91 aa, Artificial Sequence
  Computer-generated peptide variant
KLRIFRRIWKRWQTSSHVIRRSKKNNKYAVRPEARRIRYKPLVIKELALHHARLKANEPMLVIAQLWEKALKKFAARKKLKLGKRMALLYA

SEQ ID NO: 6056 - protein, 46 aa, Artificial Sequence
  Computer-generated peptide variant
RMRMMRRFLRMWRRLAGAHYAAKAKCTKRNRDMDLDALKIYRARQA

SEQ ID NO: 6057 - protein, 33 aa, Artificial Sequence
  Computer-generated peptide variant
LFRYYKRMWRKLSKRTWVVLLKKSAAAWDRLKM

SEQ ID NO: 6058 - protein, 32 aa, Artificial Sequence
  Computer-generated peptide variant
ILRFLKRLWRKLRHRGLKSKQALTLLREVCCK

SEQ ID NO: 6059 - protein, 24 aa, Artificial Sequence
  Computer-generated peptide variant
RLKFLRKFWRWLRPLLRKVLYPHY

SEQ ID NO: 6060 - protein, 42 aa, Artificial Sequence
  Computer-generated peptide variant
RLRIFRKLFKKIRNALFPRAATIFDWPCRRKAKVRMRLLDWL

SEQ ID NO: 6061 - protein, 26 aa, Artificial Sequence
  Computer-generated peptide variant
MLKMLKRIIRLLKKLQNVVAKKLDKC

SEQ ID NO: 6062 - protein, 30 aa, Artificial Sequence
  Computer-generated peptide variant
LLRLIPKYYKRLKKLQAMTFRYSQRRHARN

SEQ ID NO: 6063 - protein, 66 aa, Artificial Sequence
  Computer-generated peptide variant
RLKLITKFWRRYRPLAWHHNTARRPNLLIEFRWAHGADLNKKLNARDLKKDKARGLLKAVKAMKGQ

SEQ ID NO: 6064 - protein, 67 aa, Artificial Sequence
  Computer-generated peptide variant
FMKWIRRFMKRFKCRREALPCHPGKSMLARVLLHGARKAAKRLFCAKLARDCRKANCHCRNDARARH

SEQ ID NO: 6065 - protein, 83 aa, Artificial Sequence
  Computer-generated peptide variant
RWKFFKKLLRRFQRAHDPKKNKIEISKLKAMAALTAALPDKNGQAYLQKMDTPRKARDASRKKAAIAKLYLMKQITRIAFLLR

SEQ ID NO: 6066 - protein, 41 aa, Artificial Sequence
  Computer-generated peptide variant
FWRFLRRFFRMLPQAKCNAWRARHKALALMASIKDAKRWAH

SEQ ID NO: 6067 - protein, 34 aa, Artificial Sequence
  Computer-generated peptide variant
FFRYWSKLFRLWKRIDLRRILTLLKAIAKFYLAA

SEQ ID NO: 6068 - protein, 52 aa, Artificial Sequence
  Computer-generated peptide variant
LLRFLRKLYKLFKHEARSAMAAKPLARHRLALMLIRHKRQRDSSVSKWHFAA

SEQ ID NO: 6069 - protein, 24 aa, Artificial Sequence
  Computer-generated peptide variant
WFKFMHKLLRLLQKQRLKRKLRLL

SEQ ID NO: 6070 - protein, 44 aa, Artificial Sequence
  Computer-generated peptide variant
MWRFIQKMMRLLRRAGAAKGAYDLKPHDRFLRAARRQMRRAKNL

SEQ ID NO: 6071 - protein, 36 aa, Artificial Sequence
  Computer-generated peptide variant
KFKFWTRFLRFYHRRMKLLIAFILLLEFKAKACRDK

SEQ ID NO: 6072 - protein, 33 aa, Artificial Sequence
  Computer-generated peptide variant
KFKLMTRIMKRLPKRAVMFRAQCKHSAALRGLR

SEQ ID NO: 6073 - protein, 47 aa, Artificial Sequence
  Computer-generated peptide variant
LLRFWSKYFRKFRKDRRLAWARRAINARNIKALKGDRLQAYLLCRLQ

SEQ ID NO: 6074 - protein, 80 aa, Artificial Sequence
  Computer-generated peptide variant
LWKLMCKLLRLIPTKIARQMRRIIFGKAEAAQTLPRKYTVAALRSPKRGMRAKARFSWLKKCLRKAALVRKMGYNFLKAL

SEQ ID NO: 6075 - protein, 56 aa, Artificial Sequence
  Computer-generated peptide variant
RLKLLRKWWRFLRRRARKEPKEKALCKSGSMAFWDQLKTKVNAQVKKDKLLALRHP

SEQ ID NO: 6076 - protein, 40 aa, Artificial Sequence
  Computer-generated peptide variant
RWRLYRKILRLIKPIPPALTRKKSCFAPAAPLSLKTKFMK

SEQ ID NO: 6077 - protein, 63 aa, Artificial Sequence
  Computer-generated peptide variant
RFKFFRKLLRKYCNRRRANRARLGTRRLTAALMANAALAPSLRSRLVGAQKARMLHNLGPHAQ

SEQ ID NO: 6078 - protein, 37 aa, Artificial Sequence
  Computer-generated peptide variant
KFKLLKKLFRFLKRAARKGLYQSKLGVYLRLNITKAL

SEQ ID NO: 6079 - protein, 62 aa, Artificial Sequence
  Computer-generated peptide variant
LFKWIKRFYRLFRCLHGYKKEALRLLAGNKREPRIALPRVNQLTARRAHLQALQKRARGARA

SEQ ID NO: 6080 - protein, 34 aa, Artificial Sequence
  Computer-generated peptide variant
KLRFLRRYYRRWPTKQLHMAMRKASLAYLLLQQS

SEQ ID NO: 6081 - protein, 41 aa, Artificial Sequence
  Computer-generated peptide variant
RYRLLQRMWRFYCNKKLAMMLLWYARLSLRNGLKLRWRATF

SEQ ID NO: 6082 - protein, 51 aa, Artificial Sequence
  Computer-generated peptide variant
FLRWMQKLLKLFRTKFRAWCYREKWLQKRHALCCAKFAKVKAHKAGFAALI

SEQ ID NO: 6083 - protein, 56 aa, Artificial Sequence
  Computer-generated peptide variant
RLRMFRKLIRKLRKFRVTYRPIDATAAKLERIWWLKAQKWLRTPLKERPQLKWILV

SEQ ID NO: 6084 - protein, 63 aa, Artificial Sequence
  Computer-generated peptide variant
KWRLMCKLWKWLKKKDARYAMLAQGEERLCDQPFTAYKKLRPRMKKPKLRLLFAARHTQGAAR

SEQ ID NO: 6085 - protein, 20 aa, Artificial Sequence
  Computer-generated peptide variant
LLRFLSRLYKFIKRRELRVF

SEQ ID NO: 6086 - protein, 46 aa, Artificial Sequence
  Computer-generated peptide variant
FIRMFNRILRKMKKRKLVLTKPHGSNFLWARLRYTALLRRKACGKA

SEQ ID NO: 6087 - protein, 60 aa, Artificial Sequence
  Computer-generated peptide variant
RLKFLRRLLRRIQKYELANEKMYSKWLAKKAAYATNAMKPALRAQMKLWNPWTKRMKHKL

SEQ ID NO: 6088 - protein, 49 aa, Artificial Sequence
  Computer-generated peptide variant
KFRWITRLMKYFKKGWDKAQVRYALARRLYARPAKAAPICLFTNLFKKR

SEQ ID NO: 6089 - protein, 31 aa, Artificial Sequence
  Computer-generated peptide variant
KLKYMKKLFKYLRRLDRMLNAKGMGRQLLLA

SEQ ID NO: 6090 - protein, 37 aa, Artificial Sequence
  Computer-generated peptide variant
WLKYLKKLLKRMKKRRRRKLPAQWTARANFAEEVNLY

SEQ ID NO: 6091 - protein, 32 aa, Artificial Sequence
  Computer-generated peptide variant
LFKLLRKYWKWFRCNCWNCRALTRAKARCCLA

SEQ ID NO: 6092 - protein, 47 aa, Artificial Sequence
  Computer-generated peptide variant
LYRWLTRLFRRFPRDLPAKLRRCYHVKRSKAAATLPRDGKWLATRCT

SEQ ID NO: 6093 - protein, 20 aa, Artificial Sequence
  Computer-generated peptide variant
LLKFLCRLIRFWNPWRKAGK

SEQ ID NO: 6094 - protein, 43 aa, Artificial Sequence
  Computer-generated peptide variant
RLKLLCKLLKRFHCILASASPLRRLHKRKTNAHDRKGKERLRN

SEQ ID NO: 6095 - protein, 23 aa, Artificial Sequence
  Computer-generated peptide variant
RFKFWNRLFRIMQKRAMRANAAL

SEQ ID NO: 6096 - protein, 59 aa, Artificial Sequence
  Computer-generated peptide variant
FLKLMHRFLKLLRRKLFLRRRSSILQIEWLRWEHHIFERRKGKARQALCLKNLRCKAAL

SEQ ID NO: 6097 - protein, 74 aa, Artificial Sequence
  Computer-generated peptide variant
RFRLLCRWYRRLKHHLIIKRLQKLLKDLLRLLNRLLGKVRHCIFRKRWNGLEWMKQAAKTAGMTNALSELFLIL

SEQ ID NO: 6098 - protein, 87 aa, Artificial Sequence
  Computer-generated peptide variant
KFRYIQKLIRLIKRLQPLPMLRKALNVALQCRNAERRQKPNKAILDRMALKAAPRRKKAERCEHTAKLQVEAEKLRKKRLALYGTRG

SEQ ID NO: 6099 - protein, 51 aa, Artificial Sequence
  Computer-generated peptide variant
RMRIFKKIMRKFRTRHAQKKALHHKRRAPADLAGRLLAFELADILACRYQM

SEQ ID NO: 6100 - protein, 40 aa, Artificial Sequence
  Computer-generated peptide variant
FLRYMQKIIRYFHKVKRSTRLYAALRIKLLRIKPKASKSA

SEQ ID NO: 6101 - protein, 55 aa, Artificial Sequence
  Computer-generated peptide variant
IYKILCRMFRKLKPAQDSLTLYAQIKLEIFWKAKTLCKLCRKKRPARRTQARLLR

SEQ ID NO: 6102 - protein, 23 aa, Artificial Sequence
  Computer-generated peptide variant
KYKLLQRYLRLLNPAKGKITALK

SEQ ID NO: 6103 - protein, 43 aa, Artificial Sequence
  Computer-generated peptide variant
KFKMLRRFLKKLKKVGKRHRHARVILQLSNVARLSDVKLACYI

SEQ ID NO: 6104 - protein, 28 aa, Artificial Sequence
  Computer-generated peptide variant
RLKFWCKFFKYWKQLHSLKILALAKAHR

SEQ ID NO: 6105 - protein, 39 aa, Artificial Sequence
  Computer-generated peptide variant
IFRWLRRYLKYFKKERHFLKLKALAAALMCCCCSYKLRH

SEQ ID NO: 6106 - protein, 22 aa, Artificial Sequence
  Computer-generated peptide variant
ILRFYPKLLKKLHHMAMRRVAA

SEQ ID NO: 6107 - protein, 25 aa, Artificial Sequence
  Computer-generated peptide variant
MLRLFSKFLRRFPKLPKALQGFKKA

SEQ ID NO: 6108 - protein, 96 aa, Artificial Sequence
  Computer-generated peptide variant
KLKLFHRIFRLWRPYDLAKSPKAPAAGVARPSKSLRQKCPQLKTFPDALRRALWVFELYHRRALLRHCRKRRKPAQRLRTYAAAWKTFKPRHAWRR

SEQ ID NO: 6109 - protein, 55 aa, Artificial Sequence
  Computer-generated peptide variant
YLKYFRRLWRRIRPNIARPKAIADPKMKRRALKLLRPMMKLLLHWLIYAMKAARR

SEQ ID NO: 6110 - protein, 36 aa, Artificial Sequence
  Computer-generated peptide variant
FLRFWNRLLKKFKTFFEWRKALQFADACRKFKLRAV

SEQ ID NO: 6111 - protein, 69 aa, Artificial Sequence
  Computer-generated peptide variant
KLKLFCRLMRKLCRPDKTATLGDFIRQRNLRLKLVQKACKCRKAASLLANFFWQAHLMRYAIKCARNRH

SEQ ID NO: 6112 - protein, 20 aa, Artificial Sequence
  Computer-generated peptide variant
LMKWLRKIMKRFKCLYAAAQ

SEQ ID NO: 6113 - protein, 28 aa, Artificial Sequence
  Computer-generated peptide variant
LLRYFRKYYKRLKSSIAAYPARVASKYK

SEQ ID NO: 6114 - protein, 39 aa, Artificial Sequence
  Computer-generated peptide variant
RLKLMRKIMKKIRCWGTACVLKYKRLLKAKLLKTHNTLA

SEQ ID NO: 6115 - protein, 28 aa, Artificial Sequence
  Computer-generated peptide variant
YFRLFRRLFKFFKRRAPLLKNSLYLVAL

SEQ ID NO: 6116 - protein, 49 aa, Artificial Sequence
  Computer-generated peptide variant
RWKLMSRLFRKLRHPACDDALGFLLTDKLMKSLKFKLRCRMYCSARWAL

SEQ ID NO: 6117 - protein, 42 aa, Artificial Sequence
  Computer-generated peptide variant
KYKFLKKLIKKYKKMAHGPRAYTLYRLLFLCRKEDALLQDLD

SEQ ID NO: 6118 - protein, 34 aa, Artificial Sequence
  Computer-generated peptide variant
LIKMFKRILRRMSCRRKDNLIWRELLLGCAKLLR

SEQ ID NO: 6119 - protein, 30 aa, Artificial Sequence
  Computer-generated peptide variant
LYKLYNRFLKRWRKCRESKLHTAKAAGQKN

SEQ ID NO: 6120 - protein, 44 aa, Artificial Sequence
  Computer-generated peptide variant
RFKLLKKFLRKLKNLAGNLKTNSWARPRKWDLKAFAVIAKLNGV

SEQ ID NO: 6121 - protein, 36 aa, Artificial Sequence
  Computer-generated peptide variant
RLRWWKRWLRLFRCLKRKCLVRRFNGFILLILHALY

SEQ ID NO: 6122 - protein, 64 aa, Artificial Sequence
  Computer-generated peptide variant
LWRLLHKWFRMFKRKWLDCHRMAKLFARPRNFLLMARKMANKEHGAMLKFELLAAHALKAMHLH

SEQ ID NO: 6123 - protein, 28 aa, Artificial Sequence
  Computer-generated peptide variant
MLKLYRKIMRLFHHHYLGLAKGRRLLCL

SEQ ID NO: 6124 - protein, 28 aa, Artificial Sequence
  Computer-generated peptide variant
RIRLLRRFYRLLSRCRTLTMYRLCHLRN

SEQ ID NO: 6125 - protein, 29 aa, Artificial Sequence
  Computer-generated peptide variant
KWRILRKMLRFFNQKAEKGRVALKAHNCA

SEQ ID NO: 6126 - protein, 22 aa, Artificial Sequence
  Computer-generated peptide variant
YFRLLKRLWKRWPKLMALDKMM

SEQ ID NO: 6127 - protein, 66 aa, Artificial Sequence
  Computer-generated peptide variant
KLRLLRKIIRKFQRAMGCIDVAALGKHAFYPNLNRKLAALRYKRPRELKVKNKNKRLYALKRSCNA

SEQ ID NO: 6128 - protein, 77 aa, Artificial Sequence
  Computer-generated peptide variant
LLKLLRKLFKRFKNLARLKLRLRAAKSCEYLAFVQEKRLVPCAPQWFLVKLGRNAIKQFRGGWYRKLLKIKIVICHL

SEQ ID NO: 6129 - protein, 29 aa, Artificial Sequence
  Computer-generated peptide variant
RLRWLPKFMRMLKTSKKDLRLATKLLQNS

SEQ ID NO: 6130 - protein, 22 aa, Artificial Sequence
  Computer-generated peptide variant
RFRFLKKILKRIKPLDAKAALE

SEQ ID NO: 6131 - protein, 23 aa, Artificial Sequence
  Computer-generated peptide variant
RFKMLHKLLRRLKRMAFYVCAKG

SEQ ID NO: 6132 - protein, 42 aa, Artificial Sequence
  Computer-generated peptide variant
RIRFYRRLFRWLRSAKLRLKRVGAAFLWLLLTKDLKNDKKTS

SEQ ID NO: 6133 - protein, 52 aa, Artificial Sequence
  Computer-generated peptide variant
KWRFLQRLLRRLNKLMKWKCLLCRWPKMLLHGSLASFKQAKRMDMKLKHPLA

SEQ ID NO: 6134 - protein, 68 aa, Artificial Sequence
  Computer-generated peptide variant
KLRFWQKLLKRWKPTAAYRKMRVCSQRALARGKFWSTKFCRCWAGAALVRMRDRQRRLRHALATRAEG

SEQ ID NO: 6135 - protein, 82 aa, Artificial Sequence
  Computer-generated peptide variant
RLKLFNKYLKWIRCDAAKWIAAMAPVYHFCAEKQFKCKALRTTCKLFRLARAHLKKPLLRHRRCSLRQERTKKHAARLFKCR

SEQ ID NO: 6136 - protein, 96 aa, Artificial Sequence
  Computer-generated peptide variant
KYKWYSRLFRRFKNGGRRKCRLKRLLSKPCKKALRAAMPQSKFKPNKALALRYANAWGSRDRKLRFNKAGASYAARLLIAARSRCALKGRGAAHKH

SEQ ID NO: 6137 - protein, 22 aa, Artificial Sequence
  Computer-generated peptide variant
LLRMLKKLLRKIKQLLRKLDGY

SEQ ID NO: 6138 - protein, 24 aa, Artificial Sequence
  Computer-generated peptide variant
ILKFFRRLLKRFCRASLYWCKHRA

SEQ ID NO: 6139 - protein, 47 aa, Artificial Sequence
  Computer-generated peptide variant
KMKMIRRWLKLWRKKRPYRADFILAEAQTKTAHLDLRRAFQLRAVLK

SEQ ID NO: 6140 - protein, 52 aa, Artificial Sequence
  Computer-generated peptide variant
RYRLFRKWIRRFKHWKLFEQKHARRGDADNLARAAAARNLLDYRLMAGHEKK

SEQ ID NO: 6141 - protein, 25 aa, Artificial Sequence
  Computer-generated peptide variant
YLKFIRRLLRMFNRSLRMEMRHAKA

SEQ ID NO: 6142 - protein, 50 aa, Artificial Sequence
  Computer-generated peptide variant
KLKFITRLIKKLRRHKTALVGGNARAAKHSDALRSKQQAAECILRKKAKY

SEQ ID NO: 6143 - protein, 99 aa, Artificial Sequence
  Computer-generated peptide variant
RFKLFRKWFKYYNRAPIRNLCAGHIRGSYYLPYWCRLAASAFLMQRISAKASRKAKWLLARAIKCKALKSLILKRLLATIATKRALLPFADTNKLNFAK

SEQ ID NO: 6144 - protein, 28 aa, Artificial Sequence
  Computer-generated peptide variant
WYRWWKRLLKLWKKRLFTKHAAAKRILA

SEQ ID NO: 6145 - protein, 51 aa, Artificial Sequence
  Computer-generated peptide variant
KLRLIRKFLKRMQTLRYAIWRLGRAWRNLPAFRANRAVRRARGYMCFWKVR

SEQ ID NO: 6146 - protein, 35 aa, Artificial Sequence
  Computer-generated peptide variant
WYRYIKKYIRKFKRKPLLGLERLILKLALLYNLLT

SEQ ID NO: 6147 - protein, 63 aa, Artificial Sequence
  Computer-generated peptide variant
RLKLLKRLMKKIKHKLYVLKVAQGLHTRLKRVFAHLYLELMCLKLTPRWEIILRLFKKHYERL

SEQ ID NO: 6148 - protein, 42 aa, Artificial Sequence
  Computer-generated peptide variant
RLRWLQRFYRKWRRHIPAVKALMAGLQKSARLRWAAPPHIAL

SEQ ID NO: 6149 - protein, 68 aa, Artificial Sequence
  Computer-generated peptide variant
KMRWLSKMLRRLKRKLPYGNFVRPKKLECRSTARPKSKLALFLPYRLLQDQCSCHKAIANALAKKALL

SEQ ID NO: 6150 - protein, 20 aa, Artificial Sequence
  Computer-generated peptide variant
RLRLINRLLRMLHRVFYQRH

SEQ ID NO: 6151 - protein, 81 aa, Artificial Sequence
  Computer-generated peptide variant
RLKLLKRLYRFFPRAKLQIRFGSLELKASVKFAEPIRLRLKDKPARKRVQRLYRLAKARATAPDKILDFKLVAIKYVKQCL

SEQ ID NO: 6152 - protein, 84 aa, Artificial Sequence
  Computer-generated peptide variant
LIKYLRKFWRLMRRRHFATYPHAAKLHASLILYKKDYKACKACNGHQVARQKAAVLLLRGRKLRGLAVLCRAKFSARRNEGNRL

SEQ ID NO: 6153 - protein, 54 aa, Artificial Sequence
  Computer-generated peptide variant
WLRFLTRLIRKWKQKSPKNYLRAAPRLPELKRCQPPANPFLALNKARPVKPKAA

SEQ ID NO: 6154 - protein, 98 aa, Artificial Sequence
  Computer-generated peptide variant
FFKIFRRFFRMLKCQHMKALLRGQRNLLQDLENIIKARKPLTKVRAALAKKQRRMAHKHLIAVRCVHKLIRVTRALVKYCKACRQLRKGLLALKSSIK

SEQ ID NO: 6155 - protein, 70 aa, Artificial Sequence
  Computer-generated peptide variant
RWKFLKKWFRKMNCRAEMRLCCAWRLKHAKFAGKAARMARLLRAIKAKRLRKAMQEKITFCQWADKASLI

SEQ ID NO: 6156 - protein, 57 aa, Artificial Sequence
  Computer-generated peptide variant
KMRFFKKLIKKFKQLAAAVSSKWRRSIALLLVSIKFKHEQAILRKVRRAFLKANIQL

SEQ ID NO: 6157 - protein, 43 aa, Artificial Sequence
  Computer-generated peptide variant
KLRYYKRFLRKLPRMDDAPKRAAPATGFPFKCLRSMKRLTAEA

SEQ ID NO: 6158 - protein, 30 aa, Artificial Sequence
  Computer-generated peptide variant
FFKMLQRMFRKLRTERLDAAAAYCSLKSKA

SEQ ID NO: 6159 - protein, 75 aa, Artificial Sequence
  Computer-generated peptide variant
KLKLIHRLWKWIRKLQVWTLKAAADLKKIMVRAGLKKMRAHLKAKFPQKECMAAKSDHKYLYRRQESLNRKDVRR

SEQ ID NO: 6160 - protein, 56 aa, Artificial Sequence
  Computer-generated peptide variant
MLKLYKRMYKLMHRKAELSPIRACTLLKNEIRAQRGKRHRLKSAGKRAMDAWNARK

SEQ ID NO: 6161 - protein, 22 aa, Artificial Sequence
  Computer-generated peptide variant
LIKFFNKWLKRFSKALARLNAV

SEQ ID NO: 6162 - protein, 24 aa, Artificial Sequence
  Computer-generated peptide variant
RFRYFNRLFRKMPRLLLLNPAKRL

SEQ ID NO: 6163 - protein, 50 aa, Artificial Sequence
  Computer-generated peptide variant
KWRLFQKLMRRYKKERQAEICGLVLAKFARPAAYAKALRKDLHEWKQACA

SEQ ID NO: 6164 - protein, 81 aa, Artificial Sequence
  Computer-generated peptide variant
KLKLFTRLYRKFKNLILGLEACLMLMAFRLLLLKAYKPASAKVLFEKSRRHLKLNTWNLKLPLASRYEDDCKKMPRKMKCK

SEQ ID NO: 6165 - protein, 20 aa, Artificial Sequence
  Computer-generated peptide variant
KFRILCRYLRFFKQKLALRA

SEQ ID NO: 6166 - protein, 76 aa, Artificial Sequence
  Computer-generated peptide variant
LFKFIKKYWKLYTSVKRKIYRLARLRAYKRLALICARALKSAKRAEKTWDLTLCVFAYAESLKKAEDAQLIVEWPK

SEQ ID NO: 6167 - protein, 33 aa, Artificial Sequence
  Computer-generated peptide variant
KMKWLRRFLKRFCTKAKTLAKSFPLDRARLNLA

SEQ ID NO: 6168 - protein, 36 aa, Artificial Sequence
  Computer-generated peptide variant
LMRWFRRIFKYYRKARQALAALMRRLLTNEKMKRAC

SEQ ID NO: 6169 - protein, 42 aa, Artificial Sequence
  Computer-generated peptide variant
KFRYFPRMLKRLQRRHPQLLKAALCRPLMQHAKAYKKQPAFL

SEQ ID NO: 6170 - protein, 58 aa, Artificial Sequence
  Computer-generated peptide variant
IYRMIKRLFRRLHQERKASKLHTRLRSKAIAKRKKPQWERALLRRTAMYAAMPNYALK

SEQ ID NO: 6171 - protein, 46 aa, Artificial Sequence
  Computer-generated peptide variant
KLKLFSRLYKLLPCLAYMWLQRDKKKRLVWSFVRKKKLLWIRLKLR

SEQ ID NO: 6172 - protein, 40 aa, Artificial Sequence
  Computer-generated peptide variant
LLRWLQRLLKRLKKIRLKNPRELKKKIRMKFRLLCSLCVQ

SEQ ID NO: 6173 - protein, 75 aa, Artificial Sequence
  Computer-generated peptide variant
LIRFWCRIWRLIRTGRHYARELRRNLEAASLMNKAMWWKRRDAAGHKLKAPATSLKWARIACKMAKAKRKTLIAL

SEQ ID NO: 6174 - protein, 78 aa, Artificial Sequence
  Computer-generated peptide variant
LLKILRRLFKFYKKQWLWGRLDKRRFAAKQDMKCLCRRAQVWIWADFNAKARHQKLKILALKRKCAPDRKAGMSDKGA

SEQ ID NO: 6175 - protein, 94 aa, Artificial Sequence
  Computer-generated peptide variant
KLKLLRKLFRMLRQNRRLFLKLSCKSDPRNLRLRKTKALKHWWFALEESELVGPAPRKDTQRLKKLIALKWQKFRAFASPNALRYKTARDHQSG

SEQ ID NO: 6176 - protein, 35 aa, Artificial Sequence
  Computer-generated peptide variant
RLRFMKKYLKLWRKRICLGRARLARMAKAPLSAHR

SEQ ID NO: 6177 - protein, 68 aa, Artificial Sequence
  Computer-generated peptide variant
KLRLLKKLYRRWPKCRRRAFRNGVLKLPPTRLKECAKLVQIRAHSLLLWAQANSHLRKACRWSEAAFL

SEQ ID NO: 6178 - protein, 37 aa, Artificial Sequence
  Computer-generated peptide variant
LIKLFRKMLRRLKKHNKKRSYKHLNTYQFQLAAKMCA

SEQ ID NO: 6179 - protein, 67 aa, Artificial Sequence
  Computer-generated peptide variant
MLRYYRRFLRKLRNEKKSLALQRNKKYWRGVRAANVAARLLKSCLRPRRHTATACRCSVRCRLTALT

SEQ ID NO: 6180 - protein, 55 aa, Artificial Sequence
  Computer-generated peptide variant
LMRLWRKMIKLMRRGNNRKHQKAAFALLHILAFADIKGRAEKKTALRVKRQFWPL

SEQ ID NO: 6181 - protein, 43 aa, Artificial Sequence
  Computer-generated peptide variant
IIRWYKKLFKRLKCAAQGKKCLKKLANMNGKTDMRLLWLKGKD

SEQ ID NO: 6182 - protein, 48 aa, Artificial Sequence
  Computer-generated peptide variant
LLKLLKRYLRRINRDRLEQSLALGLVVAGRRDAACRLNMNRRCFGYKI

SEQ ID NO: 6183 - protein, 56 aa, Artificial Sequence
  Computer-generated peptide variant
YIKFLRKWLKKLKRSWAKRIVRHIRAQERLVFCKLPKELVALKNASEGALKRLLCC

SEQ ID NO: 6184 - protein, 53 aa, Artificial Sequence
  Computer-generated peptide variant
RWRILRRWFKFFRSVGLAFGRAAKLAHRPDLHAKATIFRGLQACALKAMARAA

SEQ ID NO: 6185 - protein, 40 aa, Artificial Sequence
  Computer-generated peptide variant
YMRLYKKLLKIYKRLSHKKSYRIKAAWDLLYVKYLIKEAV

SEQ ID NO: 6186 - protein, 28 aa, Artificial Sequence
  Computer-generated peptide variant
LLKLMKKLYRRYRCGEKLLARFIMSLKL

SEQ ID NO: 6187 - protein, 41 aa, Artificial Sequence
  Computer-generated peptide variant
KWKLWKKMWRLLKKEAANRRRALKKSNLKAPILEKPSAKHM

SEQ ID NO: 6188 - protein, 50 aa, Artificial Sequence
  Computer-generated peptide variant
RIRIWKRWYKILCRREKVFWSSAKTIMLLRAKRITLRLLCWAAKALKQAK

SEQ ID NO: 6189 - protein, 34 aa, Artificial Sequence
  Computer-generated peptide variant
LFKLIHRFLKKLNHAKWHKHRPTANKVLKLECLR

SEQ ID NO: 6190 - protein, 34 aa, Artificial Sequence
  Computer-generated peptide variant
LIKMYRRFLRKMKNLQRAMYAGSWACAAFAWARK

SEQ ID NO: 6191 - protein, 21 aa, Artificial Sequence
  Computer-generated peptide variant
KFRLFSKLLRIWNNAAKKSTK

SEQ ID NO: 6192 - protein, 34 aa, Artificial Sequence
  Computer-generated peptide variant
FMRMIRKLMKLLRSVRKYQRLAYLLYQRTHVALL

SEQ ID NO: 6193 - protein, 45 aa, Artificial Sequence
  Computer-generated peptide variant
LMRLYPKLFKFIRRRDAKLVRALLFNRLVKFMLARVDDRFHRSGR

SEQ ID NO: 6194 - protein, 82 aa, Artificial Sequence
  Computer-generated peptide variant
KLRFFRRLMKMLKRRPKHARDLKLFLRLREAGYTAKRLFRRLKERKWKDWAILTLERALYVKQYSRGLASLTQADGLVWATT

SEQ ID NO: 6195 - protein, 52 aa, Artificial Sequence
  Computer-generated peptide variant
KIRLMKRLFRKLRCYDLAKTQAERPLRWHARKRMKIYFAKTKAISAIMAACT

SEQ ID NO: 6196 - protein, 83 aa, Artificial Sequence
  Computer-generated peptide variant
KYRILTKLWRLLPRKRKRKNRCASANNFACGRLLNRHKFNHMQKSADPAIWALLARRRLWLLQKCVHYKVKRRFEVADKAAGA

SEQ ID NO: 6197 - protein, 26 aa, Artificial Sequence
  Computer-generated peptide variant
IFRFLRRLWRRIRTLRAADLAAVVQA

SEQ ID NO: 6198 - protein, 27 aa, Artificial Sequence
  Computer-generated peptide variant
LMRLYRKFFRKLQNKMLKNAGQLAKKL

SEQ ID NO: 6199 - protein, 36 aa, Artificial Sequence
  Computer-generated peptide variant
LFRLFKRYFKKLKRGAVYERRSLHRMAQLARIMAAI

SEQ ID NO: 6200 - protein, 51 aa, Artificial Sequence
  Computer-generated peptide variant
KLKLFHRMLRLYRRKMNAQGFAKKMRAKAIFGYRPDLALWNLCKAKALVKI

SEQ ID NO: 6201 - protein, 24 aa, Artificial Sequence
  Computer-generated peptide variant
LMRLLKRLLRKYRRNDKLAKQLIH

SEQ ID NO: 6202 - protein, 52 aa, Artificial Sequence
  Computer-generated peptide variant
RFKLFRRYLRYMNKVWKPQHEALLIKRQAMKQAADWFARALAQKCLLPARPR

SEQ ID NO: 6203 - protein, 45 aa, Artificial Sequence
  Computer-generated peptide variant
YYRLMPKLWRYLTRLYAAHFWPLKIVKGRTTVLARRRLLNWRKLR

SEQ ID NO: 6204 - protein, 28 aa, Artificial Sequence
  Computer-generated peptide variant
RLKLYHRLLKFYRKQRHHRLEAIIGPAA

SEQ ID NO: 6205 - protein, 51 aa, Artificial Sequence
  Computer-generated peptide variant
WLRIFPKLIKYWKRDKTAHKFKIFCGLALEALARKLHLDRKATHQDLAKLL

SEQ ID NO: 6206 - protein, 77 aa, Artificial Sequence
  Computer-generated peptide variant
RLKFMKRLLKFYCQYKAQRRFCAMAPIARLKDLSKLKEKYYACPLKENRYAMRLSDRVAAVRWRANAANRASAGRLP

SEQ ID NO: 6207 - protein, 76 aa, Artificial Sequence
  Computer-generated peptide variant
RIKFWRKYYKLIRKALHFWYCTCWAKDRLVKAKALKWKLKILAERPRARLCAPQRKARDCHMLAEVSRARALMNVE

SEQ ID NO: 6208 - protein, 38 aa, Artificial Sequence
  Computer-generated peptide variant
RLKFLRRFFRLLCSVRRDLLHRNAVAVKWDRLHHKSKI

SEQ ID NO: 6209 - protein, 23 aa, Artificial Sequence
  Computer-generated peptide variant
FLKLMSRLLKRMKQKTNLKKKAL

SEQ ID NO: 6210 - protein, 57 aa, Artificial Sequence
  Computer-generated peptide variant
KFRLLKKLLRKLKPKRCIKDSYAEDLQTAARAYHVQMIKHYWLKAKKKADAMYLYLF

SEQ ID NO: 6211 - protein, 30 aa, Artificial Sequence
  Computer-generated peptide variant
FLRYIQKIYRKLSKAKACAVLNRKKLRMLQ

SEQ ID NO: 6212 - protein, 53 aa, Artificial Sequence
  Computer-generated peptide variant
KWRYFKRLLKRWSSLRLLRIGTRLHARRSLLRRKYWSHMAAEGMMKFVALNAK

SEQ ID NO: 6213 - protein, 32 aa, Artificial Sequence
  Computer-generated peptide variant
KLKIFHKYFRYWHTHKKVLCLLKKRVLAAHAK

SEQ ID NO: 6214 - protein, 38 aa, Artificial Sequence
  Computer-generated peptide variant
FFRLLKKYLRKISKACYRCGQQHAMAARAFALKLDTRI

SEQ ID NO: 6215 - protein, 51 aa, Artificial Sequence
  Computer-generated peptide variant
RLKYFKKFLRKIRKYKWKRNELERIIRCCRAPAILIRKLKYLLSHILMNLL

SEQ ID NO: 6216 - protein, 45 aa, Artificial Sequence
  Computer-generated peptide variant
FLRLLRRFFKRIHSLRSRKKAKLYNLRLAKKRGCFPIFTQAQAAL

SEQ ID NO: 6217 - protein, 44 aa, Artificial Sequence
  Computer-generated peptide variant
LFKYLRKLMKKLPKMAARTDLRGKNKKRAAAKLKMDCRLCDHFP

SEQ ID NO: 6218 - protein, 64 aa, Artificial Sequence
  Computer-generated peptide variant
MFKFYKRFLRKYRTQECAHWLAKIKYAAARYAHKMKASRGMALILLMKRCRTPKRRLRLIMLLL

SEQ ID NO: 6219 - protein, 25 aa, Artificial Sequence
  Computer-generated peptide variant
LFRLLRRLLRKFSTALWKEIARAKP

SEQ ID NO: 6220 - protein, 41 aa, Artificial Sequence
  Computer-generated peptide variant
RLRLFRKWYRRFRKKLKHTVAKLGACNCLQYLKKPALAAEM

SEQ ID NO: 6221 - protein, 58 aa, Artificial Sequence
  Computer-generated peptide variant
KMKIYRRFFKRLHRANPGKLEMANAACVSAWRKSGLCALAGRLKKPAERDALKRKTEG

SEQ ID NO: 6222 - protein, 85 aa, Artificial Sequence
  Computer-generated peptide variant
RMRLFKKWFRRYNRFLRAEAKWRGYLNYKQKLPAAWCKRDLLFWLALYLPKQPKRLCGHQAPRRFLADKLAIWLMKRRLAAYYYP

SEQ ID NO: 6223 - protein, 40 aa, Artificial Sequence
  Computer-generated peptide variant
FYKFLRKLLRRWKRAARSKLNKLSFPRVWFLLARAARKLC

SEQ ID NO: 6224 - protein, 33 aa, Artificial Sequence
  Computer-generated peptide variant
RLRLIHKLYRLFRRWKRVRLLCAKALNEKRKLD

SEQ ID NO: 6225 - protein, 33 aa, Artificial Sequence
  Computer-generated peptide variant
RLRLFSKLLKLLQKFLERLRWLKRKALAHLHVN

SEQ ID NO: 6226 - protein, 21 aa, Artificial Sequence
  Computer-generated peptide variant
WLRLLKRIFRFWKRYTARQML

SEQ ID NO: 6227 - protein, 87 aa, Artificial Sequence
  Computer-generated peptide variant
KYRLLKKLYKRLKNMLCKKRMGGRSKVRFWTYMLAYHAAHARLKIGKRRLLIAKLQYDRVLFRLWQMTKKKSLAGIGVAFKAALVLA

SEQ ID NO: 6228 - protein, 79 aa, Artificial Sequence
  Computer-generated peptide variant
KLKLWCKYLRIMKNRARLELGELYAAKASKLTHFHLFILRMPMNNRRCKLKKDRRIGNGGQVAARHVRAILKLKYALAL

SEQ ID NO: 6229 - protein, 99 aa, Artificial Sequence
  Computer-generated peptide variant
MFRFLKKLLKKLQKWLAKNPRARVRRLLTELHIHVRKRLAVCWRIKGAWELRHKLTTLFHSCRWDLMKVLQKASAYDLKRLKAELCWRFLKSNRVRRSK

SEQ ID NO: 6230 - protein, 38 aa, Artificial Sequence
  Computer-generated peptide variant
RLKYLPRLMKKMNKYKLGYADFRVFRLAKKCLLEGYKH

SEQ ID NO: 6231 - protein, 61 aa, Artificial Sequence
  Computer-generated peptide variant
FFKLLKRWLKFLTSARPWRIAAWKRHKKIRYRRIALRQLAPKKKFLFNNNARSRFPWAAKV

SEQ ID NO: 6232 - protein, 24 aa, Artificial Sequence
  Computer-generated peptide variant
WIRLMKRYMKKYPRRLYLATPAKL

SEQ ID NO: 6233 - protein, 58 aa, Artificial Sequence
  Computer-generated peptide variant
KFKWLRKYIRRFHKIWFPRWAAFKLCRVWLTGAQRAKIRGFRLDRNNAHLKRRLLAAL

SEQ ID NO: 6234 - protein, 32 aa, Artificial Sequence
  Computer-generated peptide variant
RLKMYNRWFKRLKSARANANAWAKALKACLVM

SEQ ID NO: 6235 - protein, 20 aa, Artificial Sequence
  Computer-generated peptide variant
RLKLMRRLYRRLNSEPTLFL

SEQ ID NO: 6236 - protein, 20 aa, Artificial Sequence
  Computer-generated peptide variant
LIRYYNRMFKLLSKAAPKVK

SEQ ID NO: 6237 - protein, 33 aa, Artificial Sequence
  Computer-generated peptide variant
FFKWLRKWLKRMNQQAALLRKAKKLIEALRNLV

SEQ ID NO: 6238 - protein, 37 aa, Artificial Sequence
  Computer-generated peptide variant
RMRLIHRMFRRLNQAAKLLLIARMARMMKELKLQVAL

SEQ ID NO: 6239 - protein, 71 aa, Artificial Sequence
  Computer-generated peptide variant
KLKFYRRIIRRIQRFYECKLEFRDAELAHAVMLLAAAALLMLLREAKTKIRPKKESWQFAAWARKRPACRG

SEQ ID NO: 6240 - protein, 35 aa, Artificial Sequence
  Computer-generated peptide variant
RFKILKRFLRKFPHHTAAQIEYCALKRRAAAPAVK

SEQ ID NO: 6241 - protein, 23 aa, Artificial Sequence
  Computer-generated peptide variant
YFRWLRRLLRRLQQLRPVSLNAD

SEQ ID NO: 6242 - protein, 41 aa, Artificial Sequence
  Computer-generated peptide variant
LFRFLKKLLRKIRHNKLAMAAMLLIRELSYFLRWLFQRELD

SEQ ID NO: 6243 - protein, 47 aa, Artificial Sequence
  Computer-generated peptide variant
LWRLLRKLFRKLKRKMLTYQKGAWARYQCLPLLILYFTKKEVRAKTL

SEQ ID NO: 6244 - protein, 25 aa, Artificial Sequence
  Computer-generated peptide variant
RLKWYRRIFKFWKPHLRPLKLLAWL

SEQ ID NO: 6245 - protein, 40 aa, Artificial Sequence
  Computer-generated peptide variant
RLKWFKRWLRKYRRKVAIKAAEWRVKAARTMSLLAIRWDA

SEQ ID NO: 6246 - protein, 21 aa, Artificial Sequence
  Computer-generated peptide variant
KLRFLTRILKWWRRLHLATQL

SEQ ID NO: 6247 - protein, 31 aa, Artificial Sequence
  Computer-generated peptide variant
RIKLLRRLLRLYRRDKCDLKCTLMRRPLSSV

SEQ ID NO: 6248 - protein, 81 aa, Artificial Sequence
  Computer-generated peptide variant
KMRIFRKLLRKFKKAIKCRGKFADVSNDASRNYFLILRLLKLIICLKYKDAKWDLKLKKVLRISALIREAWGLRDRLKKEC

SEQ ID NO: 6249 - protein, 51 aa, Artificial Sequence
  Computer-generated peptide variant
RYKWMKRLLKRWKTKSKSLRAKKKLAPLALVLLAPEAIHLKARNVKLDAKR

SEQ ID NO: 6250 - protein, 92 aa, Artificial Sequence
  Computer-generated peptide variant
LMRFYKKWLKKLKKANLDKLAKMKAKAAAKATKLKPVRRWLHWNDYESHSCCTLCKCLKKRHMLKAPPYACRPPLIAEAAARKTAAVEKQKQ

SEQ ID NO: 6251 - protein, 64 aa, Artificial Sequence
  Computer-generated peptide variant
WLRFIRRLIKFFSRRTCKELYLRIAAANKCLALLLQMFRCKKLARIALKECKLIRPTRKRPRAK

SEQ ID NO: 6252 - protein, 52 aa, Artificial Sequence
  Computer-generated peptide variant
FYKFLKKFMRFIKKRKANLMRRLMRLYKLAPMRVWVARYADKTLRELTGGLA

SEQ ID NO: 6253 - protein, 86 aa, Artificial Sequence
  Computer-generated peptide variant
LIRLLSRYWKRIKRAVGRDGVMKLRYAKKAVMSKRLTAYYNVMYAAPVKKARKAKRIARMKCKVALRKALIRLMATKPAINAERTR

SEQ ID NO: 6254 - protein, 24 aa, Artificial Sequence
  Computer-generated peptide variant
RLKFLRKLWRWWRTHADCAYRLAE

SEQ ID NO: 6255 - protein, 47 aa, Artificial Sequence
  Computer-generated peptide variant
RYRLLHKWYRRLCKHKQLLARVPEMAPLKRIAPALQWLHKKKARAHL

SEQ ID NO: 6256 - protein, 29 aa, Artificial Sequence
  Computer-generated peptide variant
RLKLFRKWYRRLKSTYRVGRLAAVDVADV

SEQ ID NO: 6257 - protein, 43 aa, Artificial Sequence
  Computer-generated peptide variant
LLRYYKRFIRRLRQRMEQRPAIAVLKKMERWDLAAFLPKELLA

SEQ ID NO: 6258 - protein, 57 aa, Artificial Sequence
  Computer-generated peptide variant
KLRFIRKYLRLFRKRLRRLAKKAAKTDLYNKAAQSRKVSVLCRPDMLRLKSMDTECD

SEQ ID NO: 6259 - protein, 22 aa, Artificial Sequence
  Computer-generated peptide variant
FLKLLRRWWKKIQCLLARRHFM

SEQ ID NO: 6260 - protein, 21 aa, Artificial Sequence
  Computer-generated peptide variant
FLKMFRRLIRKIRNKDTACAA

SEQ ID NO: 6261 - protein, 39 aa, Artificial Sequence
  Computer-generated peptide variant
YLKYWKRLWRIIRKLLQTLPALRKTANKHKAWLAQRSKC

SEQ ID NO: 6262 - protein, 49 aa, Artificial Sequence
  Computer-generated peptide variant
KFKYLPKYLRRLQKECKFRKPWRNWARKFLLWYALMVRLRRLATINLMT

SEQ ID NO: 6263 - protein, 45 aa, Artificial Sequence
  Computer-generated peptide variant
YLKFMKKLLKRLQSKHMANYRAAKAKMAIKRALAFFADVKLMAIK

SEQ ID NO: 6264 - protein, 43 aa, Artificial Sequence
  Computer-generated peptide variant
RWKFFRKFLKLLKRTREGHTKADAQATKSLAKLERSKIWRCAQ

SEQ ID NO: 6265 - protein, 40 aa, Artificial Sequence
  Computer-generated peptide variant
RIKLLRRFLRLLKRIKRATTKCACRRCTLLSKCWVAVAKQ

SEQ ID NO: 6266 - protein, 48 aa, Artificial Sequence
  Computer-generated peptide variant
LLKWWCKWFKRFRQRELHRFPLALHDRARKLAVLIGCRNGLLKPKLKE

SEQ ID NO: 6267 - protein, 25 aa, Artificial Sequence
  Computer-generated peptide variant
RIKMLRRYLRKIQHPLATLWTRLKI

SEQ ID NO: 6268 - protein, 33 aa, Artificial Sequence
  Computer-generated peptide variant
RFKMFKKFLRLLKKALAQLWLYPMLKWKRRKQY

SEQ ID NO: 6269 - protein, 63 aa, Artificial Sequence
  Computer-generated peptide variant
ILRYFQRLLRRLNRLSRTAALLTKNVRPRPLDRMKRRAKATLLLRWKLRNIAMRLNVTWFTHV

SEQ ID NO: 6270 - protein, 21 aa, Artificial Sequence
  Computer-generated peptide variant
MFKLIHKLFKLIKKHAKAKEA

SEQ ID NO: 6271 - protein, 45 aa, Artificial Sequence
  Computer-generated peptide variant
LLKLLCRYLKLLKHKVRGVDNPKDRLNKAASAMKLPWRKKLILVL

SEQ ID NO: 6272 - protein, 39 aa, Artificial Sequence
  Computer-generated peptide variant
LIRIIPRMLKKFNRLAAPRHRAANKARDLLHLPRHYLSK

SEQ ID NO: 6273 - protein, 89 aa, Artificial Sequence
  Computer-generated peptide variant
RFKLWRKLFKKMNRLKERRYPLYFRLVKLAAKAAALVKILGAKAHEDPLRRRLLKDCPLSFPGHKPACKAKICNEARKVRGMAFYWQRD

SEQ ID NO: 6274 - protein, 65 aa, Artificial Sequence
  Computer-generated peptide variant
WLKLLRKWWRRLKPEAAKWTGWKFLKKKAALAHVRCKRHCKLRPPDLAANGVQPRAAWMLMLCVT

SEQ ID NO: 6275 - protein, 79 aa, Artificial Sequence
  Computer-generated peptide variant
RLKIWKRFWRRLHHQNAKETEEYKETRHLIMRRLGLKRLLIKMRLDAAALEALRPKIFPAKPKRLRMLRLRTALNAAVL

SEQ ID NO: 6276 - protein, 46 aa, Artificial Sequence
  Computer-generated peptide variant
MIRYMPKFYKFLHPRRIKLADAKPATLARRERRKLAACHRRWSLSA

SEQ ID NO: 6277 - protein, 51 aa, Artificial Sequence
  Computer-generated peptide variant
KLRIFKRILKKLRRRAFRRRGRASVLLCHKADIPSCGADRLALAMREWKRH

SEQ ID NO: 6278 - protein, 41 aa, Artificial Sequence
  Computer-generated peptide variant
MLKWLKKFFKRFKRWQAATRARSYRHRTKAFRLYHCAAATR

SEQ ID NO: 6279 - protein, 35 aa, Artificial Sequence
  Computer-generated peptide variant
FFKLIKKFLRRLKRPALFRYKAKMMHAAWLKRLVH

SEQ ID NO: 6280 - protein, 39 aa, Artificial Sequence
  Computer-generated peptide variant
RWRLLRRMFKKIKRRKLWQLHILNGLSKLRAYLERHFAA

SEQ ID NO: 6281 - protein, 21 aa, Artificial Sequence
  Computer-generated peptide variant
LMKLLTKLIKRLSNKAKMRQR

SEQ ID NO: 6282 - protein, 85 aa, Artificial Sequence
  Computer-generated peptide variant
WFRMFKKLMKFLCQRLNFRAKLAWYNLWKLFNSWKMRAHMKKKLADAFMWRATQPKATKARLRALANLKAKHYKHDATLPLREMA

SEQ ID NO: 6283 - protein, 29 aa, Artificial Sequence
  Computer-generated peptide variant
KFRILKKMFKFMPPAWKAWRTSRRFLAAL

SEQ ID NO: 6284 - protein, 72 aa, Artificial Sequence
  Computer-generated peptide variant
LWRLFRKIFKFLSRKFYRAAFGNHMYAKARTPLLLCRIIPLVLKARMASKNARKRPAPLLTKREKWRARVKI

SEQ ID NO: 6285 - protein, 22 aa, Artificial Sequence
  Computer-generated peptide variant
RLKLIQRLLRFFKKLHRRLWYC

SEQ ID NO: 6286 - protein, 75 aa, Artificial Sequence
  Computer-generated peptide variant
KYRLLKKIFRYLKKIRGAALCVGGAICCKKKVLDRFQASVGAAKALREAQSKRAYSCWLRALWLRLLRYKMWRAL

SEQ ID NO: 6287 - protein, 57 aa, Artificial Sequence
  Computer-generated peptide variant
LLKLLRRIFRKLSNNAHAKNVKLLQALPRTPMKRFLLAGKKVKYGMRRRALRIYPVS

SEQ ID NO: 6288 - protein, 21 aa, Artificial Sequence
  Computer-generated peptide variant
LYKMLRRLYRLWNQGKKAYLD

SEQ ID NO: 6289 - protein, 28 aa, Artificial Sequence
  Computer-generated peptide variant
FIKLMCKLFKKLKRRWLGAAGARWYKLR

SEQ ID NO: 6290 - protein, 37 aa, Artificial Sequence
  Computer-generated peptide variant
IWRLYRRFFRWLTRASKLVVKARKKRAACVAHWAMMR

SEQ ID NO: 6291 - protein, 60 aa, Artificial Sequence
  Computer-generated peptide variant
MYRLLQRFMRLLRKGGHLAQASKYRGAKWRPKMHLIAHALRIFYKAKASYLLRRFDAKWA

SEQ ID NO: 6292 - protein, 37 aa, Artificial Sequence
  Computer-generated peptide variant
RMKYLKKFWKWYRRAACQAKPAAYNDALRGRYKRADG

SEQ ID NO: 6293 - protein, 34 aa, Artificial Sequence
  Computer-generated peptide variant
MLRLFHRFFKYLKPARETRSCKLRLSYRKRLTLY

SEQ ID NO: 6294 - protein, 79 aa, Artificial Sequence
  Computer-generated peptide variant
MLRFLRKLLRYLKTRHSIALRRDALGTHLHLIALAARKPHAAKRKETSADSIAKVLQMKLRLAARAKQVAYKVLPRWSG

SEQ ID NO: 6295 - protein, 34 aa, Artificial Sequence
  Computer-generated peptide variant
RLRLLNRYFKLLKTRHIRAACAGRTRLANWRMFR

SEQ ID NO: 6296 - protein, 56 aa, Artificial Sequence
  Computer-generated peptide variant
KWKFLKRYIKKMNRAKSHKAGNMHLKRRSIRANQETAAFLLGRAKLNFAIPKLMAA

SEQ ID NO: 6297 - protein, 20 aa, Artificial Sequence
  Computer-generated peptide variant
RLRLFQRMLRLYSKAKIVYR

SEQ ID NO: 6298 - protein, 27 aa, Artificial Sequence
  Computer-generated peptide variant
KLRYLKRWLRIIRQRAQRLRHAFARAS

SEQ ID NO: 6299 - protein, 28 aa, Artificial Sequence
  Computer-generated peptide variant
KLKIYKKFFRILRKAMADSALARAKTKE

SEQ ID NO: 6300 - protein, 25 aa, Artificial Sequence
  Computer-generated peptide variant
LFRMLRRLMRRWRPRAWEEKGQLAP

SEQ ID NO: 6301 - protein, 21 aa, Artificial Sequence
  Computer-generated peptide variant
LIKYLKRIYKFFNKAHRIAKL

SEQ ID NO: 6302 - protein, 77 aa, Artificial Sequence
  Computer-generated peptide variant
YLKLWPRLIKYLRHSAEAKHTWWHKEKRQKIFQRKWLRHCRKCAKLKRMTVKAYRTLAKDQKFIALRQRPACALRAL

SEQ ID NO: 6303 - protein, 21 aa, Artificial Sequence
  Computer-generated peptide variant
LLKFLRRLYKMYKRPWLREDL

SEQ ID NO: 6304 - protein, 80 aa, Artificial Sequence
  Computer-generated peptide variant
KLRMYKRWLKRLPRLYLYVLARPAKNLMLRTMRDQDPMALCLEATWRFACTCRVEPKGLRARLKLEHRAHEAKAAQGKKD

SEQ ID NO: 6305 - protein, 71 aa, Artificial Sequence
  Computer-generated peptide variant
RIRLYRRLMRLLRPLRRCARATTRKAMQAKEFWKDRDRTARVCIRRRGQPKDKAAKAALYKDRYMNLAAPL

SEQ ID NO: 6306 - protein, 77 aa, Artificial Sequence
  Computer-generated peptide variant
LMKLLKKIFKLFKCAKLQLNAGFARGLFWAMNCYKLCLEQCCTRRFNLHTRLKSARAWRLSRAAKAIYLYRRRAARC

SEQ ID NO: 6307 - protein, 39 aa, Artificial Sequence
  Computer-generated peptide variant
KLRYFTKLLKRLKCGAQNTAKYRLLIRKARQQPMQQLLT

SEQ ID NO: 6308 - protein, 34 aa, Artificial Sequence
  Computer-generated peptide variant
FWKYLKKLLKFLSSLRRLPFKRYMAAKKRALRYK

SEQ ID NO: 6309 - protein, 27 aa, Artificial Sequence
  Computer-generated peptide variant
IIKILCRIYKRLKRLEKRLGASALLRG

SEQ ID NO: 6310 - protein, 33 aa, Artificial Sequence
  Computer-generated peptide variant
RFKLWRKLLRRMKSGLILRVAALVNRGLTAGCR

SEQ ID NO: 6311 - protein, 33 aa, Artificial Sequence
  Computer-generated peptide variant
FMRLLRRWLRKLKRNAASQSKEPAAICAANRAT

SEQ ID NO: 6312 - protein, 29 aa, Artificial Sequence
  Computer-generated peptide variant
WLRWLHRLLKRFNRVKAGLLIKRRCMKSL

SEQ ID NO: 6313 - protein, 29 aa, Artificial Sequence
  Computer-generated peptide variant
RLKMIRRLIKWIRNCLLKARWLKAISSHN

SEQ ID NO: 6314 - protein, 56 aa, Artificial Sequence
  Computer-generated peptide variant
RWKLFRKMFRIIKRWCPATAANHAWAPALRVRRALLKERAPFMMRIAERRAGAILA

SEQ ID NO: 6315 - protein, 36 aa, Artificial Sequence
  Computer-generated peptide variant
LFKFLSKYMKRYCCGQKSYKARLAATRAKARIARVR

SEQ ID NO: 6316 - protein, 98 aa, Artificial Sequence
  Computer-generated peptide variant
KWKLFHRLLKKLTQSATPKSKFCSYRKKISTTCQRLLAAGRLLRKWEDLRPPMKRALQKKSKCLKERFRFLLARDLCKKEKHLAIYIVPPALVALANA

SEQ ID NO: 6317 - protein, 46 aa, Artificial Sequence
  Computer-generated peptide variant
KMKIMRKLWKRLHRVAKEPAKTALKALWTKPAAEFAQWRRVTRYRS

SEQ ID NO: 6318 - protein, 43 aa, Artificial Sequence
  Computer-generated peptide variant
KLRLMRKFLKKFRSAAVLVLRKAKREPQNMATLGFMQRRYVLC

SEQ ID NO: 6319 - protein, 36 aa, Artificial Sequence
  Computer-generated peptide variant
KIKLFSRFLRRWRRLMAAWAPHHMRKLAFKMTMLWK

SEQ ID NO: 6320 - protein, 47 aa, Artificial Sequence
  Computer-generated peptide variant
FWKILRRMYKFLRRERKKRRQRAIAALAPIFKQVDAHNPLKKSLWLH

SEQ ID NO: 6321 - protein, 93 aa, Artificial Sequence
  Computer-generated peptide variant
RWRYINKIMRWLRRTRKAYALPAWAAHRAENKKALSRLRAKICRLDFLRLRLRNKIFLKCTPAPELGKLRPLPKGCYKRAIAKLIRKRAKLRP

SEQ ID NO: 6322 - protein, 27 aa, Artificial Sequence
  Computer-generated peptide variant
WLRWMKRLWRWLRTPRAIRRAWLAIFT

SEQ ID NO: 6323 - protein, 27 aa, Artificial Sequence
  Computer-generated peptide variant
RMRLFNKLFRKIRTWNAVACVLKEKAL

SEQ ID NO: 6324 - protein, 21 aa, Artificial Sequence
  Computer-generated peptide variant
LIRLLSKYLKRLRRAYFQLVA

SEQ ID NO: 6325 - protein, 63 aa, Artificial Sequence
  Computer-generated peptide variant
KYRLWKKMFKRLRKKVMDLVKDLAQAHLLARKLAAYNAARHQACSRTKNPLLRKALMRALGYL

SEQ ID NO: 6326 - protein, 21 aa, Artificial Sequence
  Computer-generated peptide variant
FYKLIKRLWRKLNKTRELLSL

SEQ ID NO: 6327 - protein, 77 aa, Artificial Sequence
  Computer-generated peptide variant
WLRLLKRIMRKLQRKRVKLWHKLKNEKNRETRGWKVPWYRLGDMLNMQKRNRPKLLSAPALHKKRRRLAIMCAKALA

SEQ ID NO: 6328 - protein, 87 aa, Artificial Sequence
  Computer-generated peptide variant
MWKLYQKILRFLKPRSSKWVAKKPMLKKACLDHLKRVSLFAPPKLRLRCLKVAKKPAQLKKRKMEKCCEKGKRANAGTVRNALHAYK

SEQ ID NO: 6329 - protein, 20 aa, Artificial Sequence
  Computer-generated peptide variant
WLKMLKRMFKKMRPLRAMLC

SEQ ID NO: 6330 - protein, 37 aa, Artificial Sequence
  Computer-generated peptide variant
KLRMLKRLWRRLCNRLLGNYSKNSYLADLLKREQRNA

SEQ ID NO: 6331 - protein, 37 aa, Artificial Sequence
  Computer-generated peptide variant
LLKWFHRFLRILKKAKKAMFMKSLKRRAILAEVKRQY

SEQ ID NO: 6332 - protein, 60 aa, Artificial Sequence
  Computer-generated peptide variant
KLKLIKRLFRKFKRSSECWPAGTRKAILRDARTKRRALRLETDLLLMAAQKKRWAFRALL

SEQ ID NO: 6333 - protein, 30 aa, Artificial Sequence
  Computer-generated peptide variant
RIKLIPRLWKKYHQKALKNRATKFAARYEA

SEQ ID NO: 6334 - protein, 52 aa, Artificial Sequence
  Computer-generated peptide variant
ILRFLSRLIRRYQNHAKARYNRWLPFGCRLAFAKLENLRRRILPFKWAARRD

SEQ ID NO: 6335 - protein, 27 aa, Artificial Sequence
  Computer-generated peptide variant
IWRFYKRLLKFLHKKLQRKLLEYLAIY

SEQ ID NO: 6336 - protein, 40 aa, Artificial Sequence
  Computer-generated peptide variant
KIKLLRKIFKLWRRAEAAWNLRKKYRNDLLLRCLGEQVVK

SEQ ID NO: 6337 - protein, 40 aa, Artificial Sequence
  Computer-generated peptide variant
KWKFYKKLLKRWTKYAAQKHGHARGDKKWACIWARNAAIK

SEQ ID NO: 6338 - protein, 24 aa, Artificial Sequence
  Computer-generated peptide variant
LWKLLRKFLRRFKKKMHIAGDAPA

SEQ ID NO: 6339 - protein, 37 aa, Artificial Sequence
  Computer-generated peptide variant
MLKFLRRLLKKYKSDIQDKKIVYLAEVARALRKAHSL

SEQ ID NO: 6340 - protein, 77 aa, Artificial Sequence
  Computer-generated peptide variant
LFKIFKRMLKKIKTALARDTAWRHAFRPAPLIRRTLWWYAKELRRKLALPVKARPMKMRAVTVKKQAIQRKKLHERE

SEQ ID NO: 6341 - protein, 51 aa, Artificial Sequence
  Computer-generated peptide variant
LFRLLHRLLRLLKKPLLFHKKANKEVLLDMCAQRSRGQRALASDRHDVTKA

SEQ ID NO: 6342 - protein, 54 aa, Artificial Sequence
  Computer-generated peptide variant
RMRLFRRLLKRLSNAKKALDRPLARKDRRMTRLVLYASAKRPLAASKLMLKATK

SEQ ID NO: 6343 - protein, 35 aa, Artificial Sequence
  Computer-generated peptide variant
LLRWYKKLWRFFRRAKPLCMVILQLEDLALARKKK

SEQ ID NO: 6344 - protein, 50 aa, Artificial Sequence
  Computer-generated peptide variant
RMRLFNKWLRKLTPLAMWMHILNAPFAFCFRKKRAPKADAKRCCKALLRW

SEQ ID NO: 6345 - protein, 65 aa, Artificial Sequence
  Computer-generated peptide variant
KIRFMSRWLRKLHTASLQSCLATKLYKMRQRKLFELDAAAKKLCDMGARQKKTGALGDKKKLGLE

SEQ ID NO: 6346 - protein, 27 aa, Artificial Sequence
  Computer-generated peptide variant
LLKLFNKFFRKMKQKKALWQARHPAWD

SEQ ID NO: 6347 - protein, 48 aa, Artificial Sequence
  Computer-generated peptide variant
ILRWLQRYFRKLSRVAARKLEWNKLRAFKGILAVRLRAHYFRKKCMGA

SEQ ID NO: 6348 - protein, 34 aa, Artificial Sequence
  Computer-generated peptide variant
KYRLMKKFIRKLQRHLACLYALRDWKACNKSDRL

SEQ ID NO: 6349 - protein, 76 aa, Artificial Sequence
  Computer-generated peptide variant
KLKLLKRLLRLFNQHLRAAAGRATTNATLDALSALVTHLYTRDHAACLMAKKKEGKAIRAVSDRLKWHRYRDNVKF

SEQ ID NO: 6350 - protein, 31 aa, Artificial Sequence
  Computer-generated peptide variant
FWKLWRKLYRLFKPRARRKLALARHATRCIF

SEQ ID NO: 6351 - protein, 39 aa, Artificial Sequence
  Computer-generated peptide variant
FFKLMNKMFRFMRRHSKLLRPNKAHEGRIRLALKAWLKL

SEQ ID NO: 6352 - protein, 68 aa, Artificial Sequence
  Computer-generated peptide variant
KLRWYKKLFRIWNCKKLRKPRPALLRVHQCHKSALPALDEACDLAKAGMRAHMLACKAFYRAKMKKMI

SEQ ID NO: 6353 - protein, 39 aa, Artificial Sequence
  Computer-generated peptide variant
RFKLLSRFLRWLRRSYPESRYLAAKLKQQLAARRRVQQH

SEQ ID NO: 6354 - protein, 52 aa, Artificial Sequence
  Computer-generated peptide variant
RMKYIRKLLRIINRCLIGLRLCLRKHKQMQWKALLRKRGLMARAGSGSANLL

SEQ ID NO: 6355 - protein, 47 aa, Artificial Sequence
  Computer-generated peptide variant
KFRYWKKWFKKLRHLSRLRAKETTTWWAYALKKAAGPDADTAAIRLI

SEQ ID NO: 6356 - protein, 46 aa, Artificial Sequence
  Computer-generated peptide variant
KFRFYNRIYRRYNKLVPPRTARLKKREATANNALRCWGRERLKAAL

SEQ ID NO: 6357 - protein, 28 aa, Artificial Sequence
  Computer-generated peptide variant
LFKFMCKLLRKFQRAHALLMERILQRNR

SEQ ID NO: 6358 - protein, 26 aa, Artificial Sequence
  Computer-generated peptide variant
LLRLFHRLYRYMKRILKKQYLNRYAK

SEQ ID NO: 6359 - protein, 24 aa, Artificial Sequence
  Computer-generated peptide variant
LFKIYRKLLRLFNRLFKKTNLAKR

SEQ ID NO: 6360 - protein, 65 aa, Artificial Sequence
  Computer-generated peptide variant
RWRILPKLYRLMKRKPRLTYQAARYRTEAALEKRNRNLPTLDRRAAARKKLFTARIGRLRAMPIK

SEQ ID NO: 6361 - protein, 41 aa, Artificial Sequence
  Computer-generated peptide variant
RWRFLKKMFKKFKPLGRKCTKVALHSNARAVNLKIQHALAK

SEQ ID NO: 6362 - protein, 68 aa, Artificial Sequence
  Computer-generated peptide variant
FYKWLSKLFRLLSRLGALKKAWNVRKAEPKRAGDVKNAKQAALDHLNQVQKACSELDVLLFFRLARKR

SEQ ID NO: 6363 - protein, 25 aa, Artificial Sequence
  Computer-generated peptide variant
KYRFLRKWIRILQRAAAKIKLMELR

SEQ ID NO: 6364 - protein, 32 aa, Artificial Sequence
  Computer-generated peptide variant
LFKFLSKFLKFFKPALRKKVERDEACAYRLAR

SEQ ID NO: 6365 - protein, 63 aa, Artificial Sequence
  Computer-generated peptide variant
LWKLYKKMFRKIRKTSKRPPHALTANMARLRFRNTLILVAAKNAAVRGKEAKFHGARQRCALA

SEQ ID NO: 6366 - protein, 69 aa, Artificial Sequence
  Computer-generated peptide variant
RLKYLKRMWKFLRRRFRTKKLDYDKPAEYYLLRRDATPLLPLRALSYEVRLKKAACTGNAPPPSRAAAK

SEQ ID NO: 6367 - protein, 74 aa, Artificial Sequence
  Computer-generated peptide variant
FLRFYNRMLRKFTKGWPLGKWLRRKLYASARWRILYNAKKKALTKQLDNEVHAQCEPLAAKLLAAMALRAVFRA

SEQ ID NO: 6368 - protein, 46 aa, Artificial Sequence
  Computer-generated peptide variant
FLKILKRLMKKMKRKKLQRAVVCVLREALLMLDLLRRPDNVLKRLS

SEQ ID NO: 6369 - protein, 40 aa, Artificial Sequence
  Computer-generated peptide variant
KWKILKKYIRKLSQHMSRKLAVLTWRWKAAQLMAREKTAL

SEQ ID NO: 6370 - protein, 34 aa, Artificial Sequence
  Computer-generated peptide variant
LMRFLHKFLKRLRNFCMLADGPHDKNHRKRLAKA

SEQ ID NO: 6371 - protein, 87 aa, Artificial Sequence
  Computer-generated peptide variant
RYRLYCKWMRRMNKEKHRKTKISMATKCFVARDANKAAYCCLLKRAPPLPRRYVYQAKDLASRDLLQWNCAAHAKAKAKLLEKLKEK

SEQ ID NO: 6372 - protein, 29 aa, Artificial Sequence
  Computer-generated peptide variant
KLKWLPRMWKYLRRTLEIRLALVLGWKKS

SEQ ID NO: 6373 - protein, 57 aa, Artificial Sequence
  Computer-generated peptide variant
KLRLYPKIYRLFPRLLCRWGHWAKAAQMTAKFRKARKRSAHDRARYWSKKGALHLML

SEQ ID NO: 6374 - protein, 33 aa, Artificial Sequence
  Computer-generated peptide variant
LLKFLRKFIKRLPKRLLMMLMRMRAKQSHKAHL

SEQ ID NO: 6375 - protein, 26 aa, Artificial Sequence
  Computer-generated peptide variant
LWKLLHKILKRFRRLCIALRNKTAKQ

SEQ ID NO: 6376 - protein, 64 aa, Artificial Sequence
  Computer-generated peptide variant
KIRLYRKILRFMKKWFLLLMALLRAYAATRAKFFPWPKFGMKWDKATRSARQRTEKLLKLVRKF

SEQ ID NO: 6377 - protein, 65 aa, Artificial Sequence
  Computer-generated peptide variant
WFRLWTKLWKKFKCRFMQQALVGALMRAANKHIAMRLAMLGLGAEKAKRLAKKANIHTSRLRKRK

SEQ ID NO: 6378 - protein, 52 aa, Artificial Sequence
  Computer-generated peptide variant
MMKFWNRLLRKLRSVRSLLASRAAFAAARKKERGAAIAARTGLLLLRKLNMK

SEQ ID NO: 6379 - protein, 21 aa, Artificial Sequence
  Computer-generated peptide variant
KLKFLPRYMRLLPKDKAHVAI

SEQ ID NO: 6380 - protein, 21 aa, Artificial Sequence
  Computer-generated peptide variant
MYKYMKRLFRKMQKERALFLA

SEQ ID NO: 6381 - protein, 28 aa, Artificial Sequence
  Computer-generated peptide variant
KFKWLRRLFKKIKKLVCQLSARACASDP

SEQ ID NO: 6382 - protein, 55 aa, Artificial Sequence
  Computer-generated peptide variant
MYRLYRRLLRFYRRNQFTMHRRALKVPSCARRPRRPAKAANMPAFVAAAVRRIKL

SEQ ID NO: 6383 - protein, 97 aa, Artificial Sequence
  Computer-generated peptide variant
KLKLLQRLYKIFSTYVLVRWVVPAAKNQLEQAARLLLRYEKKTRKNWTQKRLPAKSARRRAVRHRVAAVYARGLADCAFLIEWKRYALRNLVALAEV

SEQ ID NO: 6384 - protein, 25 aa, Artificial Sequence
  Computer-generated peptide variant
RLRIFKKLLKRLHPDRAKNLDAMTW

SEQ ID NO: 6385 - protein, 67 aa, Artificial Sequence
  Computer-generated peptide variant
RLRFLTKLFKLWPNTACLGDMLFAADKRRKNDLKKLPKLCKWKAKKCKAQRVRPGYAFLLCSDCRRL

SEQ ID NO: 6386 - protein, 60 aa, Artificial Sequence
  Computer-generated peptide variant
LFKFFKKFFKRWKTHLNNKKWIRAAMSDRRNGRKRKPHLFQLLALLVAIKPLARRKVAAK

SEQ ID NO: 6387 - protein, 25 aa, Artificial Sequence
  Computer-generated peptide variant
IMRLWRKLLKKYCNGNYQRLLKAYK

SEQ ID NO: 6388 - protein, 45 aa, Artificial Sequence
  Computer-generated peptide variant
LMKFIKRIFRRWKKLTAFLQWPRAKLMVIADLKGLNNARQRRNAL

SEQ ID NO: 6389 - protein, 28 aa, Artificial Sequence
  Computer-generated peptide variant
WMKLLRRFLKKFRRRNGALMKAYYHLYY

SEQ ID NO: 6390 - protein, 67 aa, Artificial Sequence
  Computer-generated peptide variant
KLRLIHKFLRRLRRLGKLAMMKPFAKAEDHAKQYELDKTKFDGAYYLRGKVLQRAEMARKNKLRARR

SEQ ID NO: 6391 - protein, 29 aa, Artificial Sequence
  Computer-generated peptide variant
FWRLIRRLIRYMQKLPLAKARNKLRHNRA

SEQ ID NO: 6392 - protein, 49 aa, Artificial Sequence
  Computer-generated peptide variant
FWKFFTKWYKMLHRARKVQCLRAKLKKRAADGLIGDFAGYLKVATARKL

SEQ ID NO: 6393 - protein, 40 aa, Artificial Sequence
  Computer-generated peptide variant
RFKIFRKWLRYIKRAKAFALKVGRHHTAAAIVRAASRFFQ

SEQ ID NO: 6394 - protein, 50 aa, Artificial Sequence
  Computer-generated peptide variant
LLRFMSRYYKRLCKLHCLSCKLAKACRKKVLRAREGLLRECLILWLKAPI

SEQ ID NO: 6395 - protein, 28 aa, Artificial Sequence
  Computer-generated peptide variant
IMKLLKRLLRFLKCKNIAPYARFVWGRK

SEQ ID NO: 6396 - protein, 43 aa, Artificial Sequence
  Computer-generated peptide variant
LLRLMRKLWKFWSRRQVRKPDKPAACTLAPKGMAAWLLAQAKM

SEQ ID NO: 6397 - protein, 40 aa, Artificial Sequence
  Computer-generated peptide variant
LLKFLTRFLRRMNRYADIKMKYTAQMRLNWAMAKWGKRLR

SEQ ID NO: 6398 - protein, 79 aa, Artificial Sequence
  Computer-generated peptide variant
LLRLFKKFMRMFSRRPCRPTKCLKAKKALLECAIKANWLQLLAKLQGECIASRRRNAAQTKRKPNYAWDAKVRKKLAKY

SEQ ID NO: 6399 - protein, 20 aa, Artificial Sequence
  Computer-generated peptide variant
LLRLMKRWMRRMKSNAAKVM

SEQ ID NO: 6400 - protein, 55 aa, Artificial Sequence
  Computer-generated peptide variant
KYKLLKKLWRKLKPAAKLPWALRGKLCCIKSRHKLKRLHLLAGCLPNKTKTRIKK

SEQ ID NO: 6401 - protein, 28 aa, Artificial Sequence
  Computer-generated peptide variant
KLKFFQKLLKYMTRLGWRAHKAKAGIKA

SEQ ID NO: 6402 - protein, 46 aa, Artificial Sequence
  Computer-generated peptide variant
FFRMLKRLLRRFRRCGRLVSKALINALKRRKNRWMLKNLLADARVG

SEQ ID NO: 6403 - protein, 54 aa, Artificial Sequence
  Computer-generated peptide variant
KMKIIRRWLRFFRCKCHRFVQAPKAHAAHRTKLRALKDRAPHKDAWNLKALMKK

SEQ ID NO: 6404 - protein, 66 aa, Artificial Sequence
  Computer-generated peptide variant
RMKLFPKLMKYLTCQRERRERKLCQMAWFLTRRLYRMKRRRDRYLWRLGYLALLGALQLQYNARRN

SEQ ID NO: 6405 - protein, 23 aa, Artificial Sequence
  Computer-generated peptide variant
RIRFMTKLLKRIKKAPSAAQPAA

SEQ ID NO: 6406 - protein, 22 aa, Artificial Sequence
  Computer-generated peptide variant
LFRYLKKFFRYLKRLEGRAMLP

SEQ ID NO: 6407 - protein, 24 aa, Artificial Sequence
  Computer-generated peptide variant
RLKLWRKMLRRWSKAALLWAKMYF

SEQ ID NO: 6408 - protein, 24 aa, Artificial Sequence
  Computer-generated peptide variant
RMKLWCKLWRRICTKAAKAELKNC

SEQ ID NO: 6409 - protein, 58 aa, Artificial Sequence
  Computer-generated peptide variant
KMRYFRRLIKFFSPCLGWARKFKKREKLLILHRLRMFGLPQIELKKLWLIEKAAAKLC

SEQ ID NO: 6410 - protein, 52 aa, Artificial Sequence
  Computer-generated peptide variant
RLKIYKRWIKRLRKGLCKIALLQARMAMQMRNRRAARCSEAYLTRGQRPRSS

SEQ ID NO: 6411 - protein, 52 aa, Artificial Sequence
  Computer-generated peptide variant
KFRWLQKYYRMWRQAGQTAAACKLAPFKRHFTRLAARCRRRKLDKHYRATLY

SEQ ID NO: 6412 - protein, 57 aa, Artificial Sequence
  Computer-generated peptide variant
LLRLWKKLMRYLRTKVVRARARERAAERRGGRREFDKIALLCLHSLACLKIIAWQHE

SEQ ID NO: 6413 - protein, 95 aa, Artificial Sequence
  Computer-generated peptide variant
KFRWLCRILKKICKIRARTRQWLLKAMLAKRPKRVLAKKMKAFRKLYLLAVAAARRHLPIKAARYLRATIEPGAANDRGILRSVWSGPSEANAQQ

SEQ ID NO: 6414 - protein, 31 aa, Artificial Sequence
  Computer-generated peptide variant
RLKLLTKFWKRFQRRLHSLALVMRYRAKKAK

SEQ ID NO: 6415 - protein, 27 aa, Artificial Sequence
  Computer-generated peptide variant
KLKLLTKLLKRFTRAAGPMKVMATDVA

SEQ ID NO: 6416 - protein, 44 aa, Artificial Sequence
  Computer-generated peptide variant
KLKLISRLIKLFQRAAHLFKCDFGNAKRAYTRLAKQNGALRQMR

SEQ ID NO: 6417 - protein, 94 aa, Artificial Sequence
  Computer-generated peptide variant
RLRILKKFYKRYSNHRQNLRKKADGAPYRATYLIKRRCKIKARDLVHRKLKVSNAMAKQMKAGLSHSKLEEAYLLRWQNKAARLCRGKLKKHKL

SEQ ID NO: 6418 - protein, 25 aa, Artificial Sequence
  Computer-generated peptide variant
LFKILKKLLRYMCKFRFLEAHWSRK

SEQ ID NO: 6419 - protein, 39 aa, Artificial Sequence
  Computer-generated peptide variant
LFKYLKRFFRFFKRAALNLKRDLAKAWFNAAQFKLRANW

SEQ ID NO: 6420 - protein, 55 aa, Artificial Sequence
  Computer-generated peptide variant
RLKFLKRLFRLMRKKRLYLMDSTKRLEALFYIFGDRRCLLKAHCAVAKLKGKMLL

SEQ ID NO: 6421 - protein, 63 aa, Artificial Sequence
  Computer-generated peptide variant
LLKFIRRFLKMFRSKKRLACRWIMLLLLMIDKKICVAPNRNLRELAPRRDAQCLIRRFLAHRK

SEQ ID NO: 6422 - protein, 65 aa, Artificial Sequence
  Computer-generated peptide variant
FLKLFKKMYRLFTRSFSAQKLRHALLKAIALDHYGKKLLKSLILKKCNALCARARMAPRITSVKF

SEQ ID NO: 6423 - protein, 41 aa, Artificial Sequence
  Computer-generated peptide variant
RYKLMKKLIRYWCRKAGFLAAQLAIHLRRDADRLPRTKSLL

SEQ ID NO: 6424 - protein, 35 aa, Artificial Sequence
  Computer-generated peptide variant
KLRLMKRFLKKIRKMKLVLQANTIAALLRAHDRDL

SEQ ID NO: 6425 - protein, 32 aa, Artificial Sequence
  Computer-generated peptide variant
FMKLLRRLIRYMCTKAKAWMCLKARGMRRKGA

SEQ ID NO: 6426 - protein, 80 aa, Artificial Sequence
  Computer-generated peptide variant
KWKILRKIMRRLKKLHLALRLLTNRKVNMLKKDFWMYARKLKNKARRLPHRIWCALTVREALHLLHGIKHKPQNEALERS

SEQ ID NO: 6427 - protein, 42 aa, Artificial Sequence
  Computer-generated peptide variant
FMKLIRKIYKYLRRRLTLHRKALECAVAGLYLHWEKLQLALM

SEQ ID NO: 6428 - protein, 43 aa, Artificial Sequence
  Computer-generated peptide variant
MLRLMKKLFKRFRRSFLRCKLHNALLRCFTKARKAKIHCWYAW

SEQ ID NO: 6429 - protein, 20 aa, Artificial Sequence
  Computer-generated peptide variant
YIKYLKRLLRMWSKKAAAFM

SEQ ID NO: 6430 - protein, 36 aa, Artificial Sequence
  Computer-generated peptide variant
KWRLLCRWLRRLNRKIAARLCAVCYWNAGKPRTPSK

SEQ ID NO: 6431 - protein, 40 aa, Artificial Sequence
  Computer-generated peptide variant
FLKYLKKFMRMLRNALRLWMVRQKLVLKWAKWECLCRDAY

SEQ ID NO: 6432 - protein, 22 aa, Artificial Sequence
  Computer-generated peptide variant
MMKLLQRLIKFLRHCAAGRTLR

SEQ ID NO: 6433 - protein, 100 aa, Artificial Sequence
  Computer-generated peptide variant
RYRFWPKWFKRWTRRKAYHLRFRRPAALEKISTMFNALSCQLGLGHQNRAYAYAKLSDSKRALLLALKFFKKTRFWLKALPRVKYRGRRKAKLLVKLDFR

SEQ ID NO: 6434 - protein, 34 aa, Artificial Sequence
  Computer-generated peptide variant
LFKFLKKYIKLFRRTKMLLLRKSQQMGLAVEPKR

SEQ ID NO: 6435 - protein, 81 aa, Artificial Sequence
  Computer-generated peptide variant
KMKMLSRMFRLLRKGYLLRRLETDYKALNKCAACAKRRAHKLRKIKARLAAYDIYLYKARGFSQLRHMELFDPHKQVLYRA

SEQ ID NO: 6436 - protein, 88 aa, Artificial Sequence
  Computer-generated peptide variant
RYRLWKRIWKRMTKVTLAAWRGAKLKKRLNDLYKFKKKLRKWQHALFAYTTPRDGARKKATARRALTSMKKWGFTLSGLTLWTAALEA

SEQ ID NO: 6437 - protein, 50 aa, Artificial Sequence
  Computer-generated peptide variant
WWKYFRRFLRLIHRCRVACRLPKKKLHKARATGCAARMLESKDIDLQLLL

SEQ ID NO: 6438 - protein, 100 aa, Artificial Sequence
  Computer-generated peptide variant
LLKYLPRLMKRFTTHAVNKYKLLLRRKTAAKNRYATCQPLRLLTKRPNHHLLAKKLQHQAHLERQCYKRCWFNKCAAECAAGRDAHKALALCAHFGKLEL

SEQ ID NO: 6439 - protein, 63 aa, Artificial Sequence
  Computer-generated peptide variant
KFKFLRRYWRKLKKMTFYQKLLKMRCRTLLDRLFKKQGGGLLGFRYLAEHLDADLAKKAIACR

SEQ ID NO: 6440 - protein, 44 aa, Artificial Sequence
  Computer-generated peptide variant
KIRLYPKLLKWFKKHHAQRMMLLYKLRHELKRALPPAKCLFILK

SEQ ID NO: 6441 - protein, 21 aa, Artificial Sequence
  Computer-generated peptide variant
LLRFLKKFLRMYRQAFGRRVT

SEQ ID NO: 6442 - protein, 29 aa, Artificial Sequence
  Computer-generated peptide variant
IFRLLKKLIKLLHTALRWYHRISLDKKFA

SEQ ID NO: 6443 - protein, 39 aa, Artificial Sequence
  Computer-generated peptide variant
LIKFFRRLWRWYTQFAKRCLWRKLLFFRKLRIKAALYKL

SEQ ID NO: 6444 - protein, 56 aa, Artificial Sequence
  Computer-generated peptide variant
LMRFLCRLWRRLKPIALLLIMMLRSWKRRCPACIALREDSSKKKKVIRTLSGKLAM

SEQ ID NO: 6445 - protein, 32 aa, Artificial Sequence
  Computer-generated peptide variant
FLKILSRWWRILTTRRAAKVLGHVGKARLYRK

SEQ ID NO: 6446 - protein, 29 aa, Artificial Sequence
  Computer-generated peptide variant
KWKILNKMLKRWRKRLLHAYMAQLAYRQK

SEQ ID NO: 6447 - protein, 68 aa, Artificial Sequence
  Computer-generated peptide variant
KIKLFKRFFKLFKRMATPYYAASSNPDACVCLKQKLALQAKAKLNVILPALAATRRLKEAFVRANAYK

SEQ ID NO: 6448 - protein, 36 aa, Artificial Sequence
  Computer-generated peptide variant
RYKLFKKLFKLWRTKMALRRWAWKRDSLNHSRLQHL

SEQ ID NO: 6449 - protein, 87 aa, Artificial Sequence
  Computer-generated peptide variant
KMRLFNKFFKRWSKRGRCCLLIQYRCAPLTRREDKWKRLLTLARWPLLRVYDLMMAIQLKRAAKLQLLKKPKNKQNAAKAKLLRTAR

SEQ ID NO: 6450 - protein, 72 aa, Artificial Sequence
  Computer-generated peptide variant
RFRMYCRIFKRIRTLRAAPLKVHKAIRATLRRDPAKRKRQLKAKLSEAHAHVGAKDKLCALCYRTLAHFEPG

SEQ ID NO: 6451 - protein, 49 aa, Artificial Sequence
  Computer-generated peptide variant
LFRYLRRWIRFLRRAKAEGLRLNYAKRASLLRLHITLGKLPKAKCAYLC

SEQ ID NO: 6452 - protein, 59 aa, Artificial Sequence
  Computer-generated peptide variant
KYKILKKLWRRLKPFRFLRVKDRMVASAKNRIAYYAAERRTNECAEALALLYAQSKLRC

SEQ ID NO: 6453 - protein, 86 aa, Artificial Sequence
  Computer-generated peptide variant
FMKLMSKMIRFFKKKKCKKAREIRADKSIDLRRRTHLKISALDAAVCRLLRARSIKPGDDARTLLYKLISEKKAKRPLKNCACLHR

SEQ ID NO: 6454 - protein, 34 aa, Artificial Sequence
  Computer-generated peptide variant
RLKWFKRLMKKLPHIRFRAAASMRALVYTRWPRG

SEQ ID NO: 6455 - protein, 23 aa, Artificial Sequence
  Computer-generated peptide variant
RYKLFKKFLRMLKTTAHLAHKQF

SEQ ID NO: 6456 - protein, 36 aa, Artificial Sequence
  Computer-generated peptide variant
WLKFWSKLLKLIPKLLAQGKNAWAKDAPTKRAKKCE

SEQ ID NO: 6457 - protein, 24 aa, Artificial Sequence
  Computer-generated peptide variant
KLRLFKKFLRLFPTHWEKLYFLLR

SEQ ID NO: 6458 - protein, 46 aa, Artificial Sequence
  Computer-generated peptide variant
LFRMLCRWLRKLKPKDNDAVAGASSKRLKLYGRSVMIRATQRLLAR

SEQ ID NO: 6459 - protein, 78 aa, Artificial Sequence
  Computer-generated peptide variant
FLRMLCKLIRRLRRCRTVRRQKGHLKELLAWLPARFELAKVARKRNAHCGKKQLVFRKARQQMKALIGNAEAVMMRLL

SEQ ID NO: 6460 - protein, 20 aa, Artificial Sequence
  Computer-generated peptide variant
RFKMYKRLMRLLQRMGKTAL

SEQ ID NO: 6461 - protein, 40 aa, Artificial Sequence
  Computer-generated peptide variant
RLKFLKKWWKKWNRLSRKAWIALLLRRRGKDGKWTLGLAV

SEQ ID NO: 6462 - protein, 70 aa, Artificial Sequence
  Computer-generated peptide variant
LLKFMKRWWRKIRRRKKAIATQNLAKRALNRSFDKLRKSWNRRDALEYAIAKIQARHKGDCRLRGYITLP

SEQ ID NO: 6463 - protein, 54 aa, Artificial Sequence
  Computer-generated peptide variant
KFKFLTRLLKLFKCAAACKLRRREKLKCPKCREYAKWAYLLLRQVASADERVIG

SEQ ID NO: 6464 - protein, 29 aa, Artificial Sequence
  Computer-generated peptide variant
LLKMIRKLFRRWQNALRVLRAHRMMKHLR

SEQ ID NO: 6465 - protein, 39 aa, Artificial Sequence
  Computer-generated peptide variant
LLRLLQRMIRILHKAARAQSVELMRASERKILKKRTPIR

SEQ ID NO: 6466 - protein, 30 aa, Artificial Sequence
  Computer-generated peptide variant
KLRFFSKILRRFKRLAKAWHAQSGYRALHR

SEQ ID NO: 6467 - protein, 87 aa, Artificial Sequence
  Computer-generated peptide variant
KLKYWCKLLKKYKKKKVIKLLQARALLQRRAHKLNISLKFKDPEYCKRLAKLRKKPFYKGLRWCKHAVPNPLTRKLAAKAVHAKQYC

SEQ ID NO: 6468 - protein, 33 aa, Artificial Sequence
  Computer-generated peptide variant
RFKYLRRFLRLLKRLNRVNALPRSYACKLLHAR

SEQ ID NO: 6469 - protein, 63 aa, Artificial Sequence
  Computer-generated peptide variant
RYRLLHKFIRYLRQRMKNAKRLNAEAAGANRWAIARSNPGKRRSKVLLAFKNRAAVRRWRDFR

SEQ ID NO: 6470 - protein, 27 aa, Artificial Sequence
  Computer-generated peptide variant
KLRFFKKLMKKLKHRAMASVLLAQLHL

SEQ ID NO: 6471 - protein, 70 aa, Artificial Sequence
  Computer-generated peptide variant
KLKLLHKLYKFFKSGLKNAFPLKLARHPFRSRLKLYLLRSELRLKAAWLVECRKQALCLKSTCDFIYANC

SEQ ID NO: 6472 - protein, 54 aa, Artificial Sequence
  Computer-generated peptide variant
LIKMYCRLLKKLRSADLVKASLAWDANQRARAAEDARRDCALRKNACIVKGTPH

SEQ ID NO: 6473 - protein, 56 aa, Artificial Sequence
  Computer-generated peptide variant
YWRWMKRMLRLMHKRFYCLDEHLARLAKILDKIRALTFRMAAVAGLANILTAARRF

SEQ ID NO: 6474 - protein, 34 aa, Artificial Sequence
  Computer-generated peptide variant
LYKLFNKFMKRFTKARACKWMKDLLQSAKCKLLQ

SEQ ID NO: 6475 - protein, 29 aa, Artificial Sequence
  Computer-generated peptide variant
FLRLIKRFLKLYKNPGQAQGLHKAAWLKV

SEQ ID NO: 6476 - protein, 34 aa, Artificial Sequence
  Computer-generated peptide variant
YYRLFTKWLKRFKNQKAAAWAAKAWPKARAMRKA

SEQ ID NO: 6477 - protein, 36 aa, Artificial Sequence
  Computer-generated peptide variant
KFRWLCKWYKRLKRRALRALLALRCRSRKSRPSLQL

SEQ ID NO: 6478 - protein, 71 aa, Artificial Sequence
  Computer-generated peptide variant
KIKFYRRWYRKLRQGLKLPPKDAEIMASAVARCYQAKRARRNRKNARKITVGQKAPLVSAKLAFLKRMAAR

SEQ ID NO: 6479 - protein, 59 aa, Artificial Sequence
  Computer-generated peptide variant
WFKMLRRILKKMRRTMAKARARINYRKMRLTRDLLQALDKLLRRLDLKAKKTIDKELAS

SEQ ID NO: 6480 - protein, 74 aa, Artificial Sequence
  Computer-generated peptide variant
LFKLFRRWLKKIRKHWRHYQGATILHRNLLDAALALAAAAQVCKKRKKKNANRDWIFERLSYKVRDRMQRKAST

SEQ ID NO: 6481 - protein, 22 aa, Artificial Sequence
  Computer-generated peptide variant
KLRMLKRLMRLLHKFVLTQRLC

SEQ ID NO: 6482 - protein, 31 aa, Artificial Sequence
  Computer-generated peptide variant
KLKLIPKYLKFLPRRYYDKWKALLARFAARL

SEQ ID NO: 6483 - protein, 55 aa, Artificial Sequence
  Computer-generated peptide variant
RFRLYSKIIRRMRRRNKAARGHALFSARKAMLKKVFKYSGTATTGMHLRLALRPA

SEQ ID NO: 6484 - protein, 29 aa, Artificial Sequence
  Computer-generated peptide variant
RLRFLKRLWKLIKQTGCRMAPLGAALWRK

SEQ ID NO: 6485 - protein, 35 aa, Artificial Sequence
  Computer-generated peptide variant
FIRFFKKMIKLLRSAHMRAVQERKRRYAARLCHLL

SEQ ID NO: 6486 - protein, 23 aa, Artificial Sequence
  Computer-generated peptide variant
LLKIIRKLLKFLKHAERVRLCDA

SEQ ID NO: 6487 - protein, 54 aa, Artificial Sequence
  Computer-generated peptide variant
KFRFLSKYLRKMHKKRNTRYPLRALNWLSKELIIALDHKLARLEERLMKPVRTL

SEQ ID NO: 6488 - protein, 70 aa, Artificial Sequence
  Computer-generated peptide variant
KYRMYKKLYKLIRRRSPHDKKNVYMHEYALCKRAADLMLGFKLLGALDKKQKADKKIRPLAIRLKHLEKM

SEQ ID NO: 6489 - protein, 33 aa, Artificial Sequence
  Computer-generated peptide variant
LYRWLRKLFRKLKPNKQMTLYRAACASLHCKRH

SEQ ID NO: 6490 - protein, 54 aa, Artificial Sequence
  Computer-generated peptide variant
KLKILRRFIRIFSPLATAKAHREKKIREKWASRLLLKRPNHLMRTLGDLKASMT

SEQ ID NO: 6491 - protein, 95 aa, Artificial Sequence
  Computer-generated peptide variant
LFKWINRIFKRYKQKFQARKDARRLASWHAACLRRRFKYYIIRLAIRSLKAIKVKLRLFANRGVNIARWIQKLELMVKRRSLHAASRKALHAATG

SEQ ID NO: 6492 - protein, 29 aa, Artificial Sequence
  Computer-generated peptide variant
RFRFLNKFLRFLKRKYALHLQFAARAWRG

SEQ ID NO: 6493 - protein, 29 aa, Artificial Sequence
  Computer-generated peptide variant
LYRMLSKLLRLYRSHLEERVPCHARRLKR

SEQ ID NO: 6494 - protein, 28 aa, Artificial Sequence
  Computer-generated peptide variant
FLRLFRRMLRLMQRKRRSKTLILTKLDL

SEQ ID NO: 6495 - protein, 77 aa, Artificial Sequence
  Computer-generated peptide variant
RIKILQKFLRKLNRHNWKRKARRHDCCPLRRCKRILHAKAVLFLPYLLTRCRRAQGRWCYKKLKCRLARTIRALAFF

SEQ ID NO: 6496 - protein, 46 aa, Artificial Sequence
  Computer-generated peptide variant
LLKLFRKYLKRYRKERGQPALHWLLRNILETLEWLCTKMGRKDALK

SEQ ID NO: 6497 - protein, 52 aa, Artificial Sequence
  Computer-generated peptide variant
RWKLWSRLLRLMRRRRDKIARYHRARMLKDERRTPAITTAHLYDMYDAKTRL

SEQ ID NO: 6498 - protein, 65 aa, Artificial Sequence
  Computer-generated peptide variant
FLRFIKKYWRKLNKSMECLAKLRAMDLGALNGTKKRLLLLEISTRILALKTGMRLAKWPTAGKAP

SEQ ID NO: 6499 - protein, 33 aa, Artificial Sequence
  Computer-generated peptide variant
LLKLFNKLWKFLHQLWARKARRSRMCLAQHFRN

SEQ ID NO: 6500 - protein, 25 aa, Artificial Sequence
  Computer-generated peptide variant
RLRLLHRWFRIFKCANKAAIKAFSR

SEQ ID NO: 6501 - protein, 20 aa, Artificial Sequence
  Computer-generated peptide variant
KLRFINRFLRMWHRALGMLK

SEQ ID NO: 6502 - protein, 27 aa, Artificial Sequence
  Computer-generated peptide variant
KLKFITKMWRFLKKKAAQMRAILGREL

SEQ ID NO: 6503 - protein, 34 aa, Artificial Sequence
  Computer-generated peptide variant
RLRWIQKLMRRFRRMAQWLKWLRAGINLRNLAIT

SEQ ID NO: 6504 - protein, 39 aa, Artificial Sequence
  Computer-generated peptide variant
YIRLLRKYFRKFRTDDASKRRAAKLRMNAPLKPCTCAAK

SEQ ID NO: 6505 - protein, 44 aa, Artificial Sequence
  Computer-generated peptide variant
KFRLIKKWIRLLTKVARLRDLKFKHSHLMRTWLQLAARLFRKGK

SEQ ID NO: 6506 - protein, 22 aa, Artificial Sequence
  Computer-generated peptide variant
RLKLWKRWFRLYKRKLWCETAA

SEQ ID NO: 6507 - protein, 47 aa, Artificial Sequence
  Computer-generated peptide variant
KLRLLRRMLKFWSRRKACNLGWDREDKARGANLAYCFHLRHFLRERL

SEQ ID NO: 6508 - protein, 25 aa, Artificial Sequence
  Computer-generated peptide variant
RYRWFKRIIRLLKKIQHLPLALALA

SEQ ID NO: 6509 - protein, 56 aa, Artificial Sequence
  Computer-generated peptide variant
RYKYYKKMFRKLKKRKLLTKGALRRRLKVADSRMLPWHLEASLPLIIGIKMKDPIA

SEQ ID NO: 6510 - protein, 60 aa, Artificial Sequence
  Computer-generated peptide variant
FLRIFRRMLRWYRKAARPMRAMRPMRLELDSWGSLLIIRHQRHVREALERRKLIRLDLKA

SEQ ID NO: 6511 - protein, 47 aa, Artificial Sequence
  Computer-generated peptide variant
RFRFWTRLFRFFCRTAYRCADAKIKKLTFAAILRFPCLAYRKKARKP

SEQ ID NO: 6512 - protein, 50 aa, Artificial Sequence
  Computer-generated peptide variant
MLKYWKRLLKLFKPKRIRLMWLVLRKADYNNDQLKNKRNRYLIAYKDKYA

SEQ ID NO: 6513 - protein, 42 aa, Artificial Sequence
  Computer-generated peptide variant
YYRLLRKLYRILRRRKDWWHREKLKLLYSPRNLKTFILTGKA

SEQ ID NO: 6514 - protein, 46 aa, Artificial Sequence
  Computer-generated peptide variant
KLRMLRRFIKRMKKALQHLKLLKKYTKLYCKWHNMRAALVLAAKVA

SEQ ID NO: 6515 - protein, 21 aa, Artificial Sequence
  Computer-generated peptide variant
FLRFIRRLWKLLTRADPMARH

SEQ ID NO: 6516 - protein, 43 aa, Artificial Sequence
  Computer-generated peptide variant
KIKFFRRILRWLCRLMVYKCANSAHWLLNFAARAKRKRLWNLY

SEQ ID NO: 6517 - protein, 56 aa, Artificial Sequence
  Computer-generated peptide variant
RLKILSKLLKKYCRRSSARPKLQKAKLRAHWASPLMQGRQMLTRIAFKMLDARAKK

SEQ ID NO: 6518 - protein, 45 aa, Artificial Sequence
  Computer-generated peptide variant
RLKLIRRLFRKFKKFRFYGLTALKQYADRLDRNLAINLLNLMRHY

SEQ ID NO: 6519 - protein, 27 aa, Artificial Sequence
  Computer-generated peptide variant
KFRLFKKYLRLLKRWGMLLGTAKFAGT

SEQ ID NO: 6520 - protein, 30 aa, Artificial Sequence
  Computer-generated peptide variant
RLRYWPKLWKKMRRKFFNLLACARNSWKLP

SEQ ID NO: 6521 - protein, 65 aa, Artificial Sequence
  Computer-generated peptide variant
WFKFWNKFWKKLTCRLNCAVKFLAVCRNAKRAKKLFLRLKASKKDARHENAWRLAMRLDADVHRL

SEQ ID NO: 6522 - protein, 29 aa, Artificial Sequence
  Computer-generated peptide variant
LFKLWCRLIKKWKNNSRRDQHLKCACAAR

SEQ ID NO: 6523 - protein, 41 aa, Artificial Sequence
  Computer-generated peptide variant
RWRFYQKLIKRWRHAPPCLKLSLFFLAALLWKASLLRGKQS

SEQ ID NO: 6524 - protein, 58 aa, Artificial Sequence
  Computer-generated peptide variant
FIKYLTRLMRRLPRLNLCLLMRAWPRLMEKLWLHDEWVRKRPAFLKWLLLMKIQPKKL

SEQ ID NO: 6525 - protein, 30 aa, Artificial Sequence
  Computer-generated peptide variant
RIKILKRLIRKLTRCALLTRLYWLRGAGRQ

SEQ ID NO: 6526 - protein, 44 aa, Artificial Sequence
  Computer-generated peptide variant
RMRLFRRFLKRIRKLDKAHLAVRPLATADARRLKKAKKRGVLQW

SEQ ID NO: 6527 - protein, 20 aa, Artificial Sequence
  Computer-generated peptide variant
FLRILKRLWRMWRCQLAADV

SEQ ID NO: 6528 - protein, 45 aa, Artificial Sequence
  Computer-generated peptide variant
KLKLWRKWFRLLSRRRLTRPLTSALTRACYESRRKTGYCAERQLT

SEQ ID NO: 6529 - protein, 58 aa, Artificial Sequence
  Computer-generated peptide variant
IWKYYRRLWKRIKKAHALNKRACSLAEARKRLACSEEAGKFSHLCRKRAKPRACWEYR

SEQ ID NO: 6530 - protein, 24 aa, Artificial Sequence
  Computer-generated peptide variant
LLRIWRKLFRYMKNKLAPSLAAKL

SEQ ID NO: 6531 - protein, 27 aa, Artificial Sequence
  Computer-generated peptide variant
KLKLLKKLWKKMHSARENMIRLLAQPS

SEQ ID NO: 6532 - protein, 48 aa, Artificial Sequence
  Computer-generated peptide variant
RFKYWRKLLRMFSKCSAYAACATARYLRSKFALLALELFNHMARFRKW

SEQ ID NO: 6533 - protein, 32 aa, Artificial Sequence
  Computer-generated peptide variant
FLRFLRKLLRRYPCAARIRASHLYANCRKPKS

SEQ ID NO: 6534 - protein, 25 aa, Artificial Sequence
  Computer-generated peptide variant
KMRLFKKFFKRMKPVRYLLAWVLHA

SEQ ID NO: 6535 - protein, 63 aa, Artificial Sequence
  Computer-generated peptide variant
MWRLLKRLYKIWRRKIKLDLLKCGKLECAGRYLMMKSAAKQGFKSNAKKKFLRSALTPSFLPK

SEQ ID NO: 6536 - protein, 25 aa, Artificial Sequence
  Computer-generated peptide variant
FLRLFNRLMRRYKQAADRRSEIRIL

SEQ ID NO: 6537 - protein, 58 aa, Artificial Sequence
  Computer-generated peptide variant
IMKYLKRYYRRFSRSWGNKKLCARSAALLVQLKYCVLMKARGLLLRGKKSARAKKRAN

SEQ ID NO: 6538 - protein, 50 aa, Artificial Sequence
  Computer-generated peptide variant
KYKIMKKFIRKYKKFWEKLARAAQRKALLIRKKLVALAASSCHAHFLEFV

SEQ ID NO: 6539 - protein, 37 aa, Artificial Sequence
  Computer-generated peptide variant
RLKWWQRIYRLYRRALDYLCNAWKRRGFRMNVAALKK

SEQ ID NO: 6540 - protein, 36 aa, Artificial Sequence
  Computer-generated peptide variant
RFRFFQRWYRKFRRPTRLFKADDAYALLLLAAWMYR

SEQ ID NO: 6541 - protein, 32 aa, Artificial Sequence
  Computer-generated peptide variant
KMRLLCRLMKKLHHIRLMKKLGDFRKLLDWGA

SEQ ID NO: 6542 - protein, 28 aa, Artificial Sequence
  Computer-generated peptide variant
LLRILRKLFKKIRRLAAKVCACCKVTAH

SEQ ID NO: 6543 - protein, 79 aa, Artificial Sequence
  Computer-generated peptide variant
RLRMYKRFFRKFRNENHFKRTPNDERGVRPLLARRQHREACLKACGAKLDKAVALTAARLRHSAKNASIATACARAKLV

SEQ ID NO: 6544 - protein, 63 aa, Artificial Sequence
  Computer-generated peptide variant
RIKILNKWLRKFHRVFWLAKPRVRKAPKKCRWGLKLRGGAWRKDLVRAQLLKAVLFDAAVWYM

SEQ ID NO: 6545 - protein, 29 aa, Artificial Sequence
  Computer-generated peptide variant
KLKFFRRFLKRLQKPWCMLLAKLMSKQLH

SEQ ID NO: 6546 - protein, 35 aa, Artificial Sequence
  Computer-generated peptide variant
KLKLWCKIIKFLRKAIRMRCKRLKQIVAYSAASEA

SEQ ID NO: 6547 - protein, 34 aa, Artificial Sequence
  Computer-generated peptide variant
ILRILRKFIKKIRPLRFWARAFLHALQKYHLKKK

SEQ ID NO: 6548 - protein, 48 aa, Artificial Sequence
  Computer-generated peptide variant
RFRLMRRMLKRLRRQLLALVTMFLHAIAWKREKRWVGQIALAYARCDQ

SEQ ID NO: 6549 - protein, 25 aa, Artificial Sequence
  Computer-generated peptide variant
LLRYLPKLLRRYTKWTSAARVAKRV

SEQ ID NO: 6550 - protein, 33 aa, Artificial Sequence
  Computer-generated peptide variant
LMKLYSRYLRIFQKDKWRVKDALRLAKYPLACA

SEQ ID NO: 6551 - protein, 62 aa, Artificial Sequence
  Computer-generated peptide variant
KFKMLRKFFRLLRKNTPSAHKGKMQLRAAGNRRLFKRTMLLKLPKLKIQEFLLASKMKVGKK

SEQ ID NO: 6552 - protein, 60 aa, Artificial Sequence
  Computer-generated peptide variant
LFKILCKLFKWYRNKAKSARHRADKFGKVRKRARPRIKRLEIEQAASDRLEAMSWLLLYR

SEQ ID NO: 6553 - protein, 20 aa, Artificial Sequence
  Computer-generated peptide variant
IMRLMRKFIKLLRNLATRKC

SEQ ID NO: 6554 - protein, 37 aa, Artificial Sequence
  Computer-generated peptide variant
RWKMWRRLLKKFKHYRYAKLSPSFAIWRMTLHKLLLR

SEQ ID NO: 6555 - protein, 26 aa, Artificial Sequence
  Computer-generated peptide variant
LLRIFRRILRMLNRPKEFLKHLLKCV

SEQ ID NO: 6556 - protein, 52 aa, Artificial Sequence
  Computer-generated peptide variant
LLRWMQRYFRFLPKLALFKGPPKKLKDNHRNAAYCRRVRAKKRAISILRLAY

SEQ ID NO: 6557 - protein, 38 aa, Artificial Sequence
  Computer-generated peptide variant
LLKMFQRLLKFICQLKARKACARRRERANYAKKLCEYL

SEQ ID NO: 6558 - protein, 29 aa, Artificial Sequence
  Computer-generated peptide variant
RMRILTRFLKYLRKKARAYMLCNHLAARA

SEQ ID NO: 6559 - protein, 25 aa, Artificial Sequence
  Computer-generated peptide variant
LLRLFHKYFKKFCRNQWKELAKAKF

SEQ ID NO: 6560 - protein, 44 aa, Artificial Sequence
  Computer-generated peptide variant
RIKFFQKILKLFTRAHIQFWKAKADYKTREFKLNALKRLALCRK

SEQ ID NO: 6561 - protein, 47 aa, Artificial Sequence
  Computer-generated peptide variant
KFRLLKKLLKFLKKGDSKAACNALKKTDKHVTSVLRKLMALWSNRKR

SEQ ID NO: 6562 - protein, 32 aa, Artificial Sequence
  Computer-generated peptide variant
RLKFLRKMLRFLQKLQCKMMLDIRKNLGKSAH

SEQ ID NO: 6563 - protein, 36 aa, Artificial Sequence
  Computer-generated peptide variant
KLRYLSRYLKMLKKRLAECIEKLIRVKLLPCALKFD

SEQ ID NO: 6564 - protein, 39 aa, Artificial Sequence
  Computer-generated peptide variant
WFRWIKKLMKIWNSARKIRLGRHWALALKLAPLARKNRA

SEQ ID NO: 6565 - protein, 38 aa, Artificial Sequence
  Computer-generated peptide variant
FLRMLRKILRFITTALGSLIRQGNLKRLAKALKNDKQK

SEQ ID NO: 6566 - protein, 27 aa, Artificial Sequence
  Computer-generated peptide variant
RYRYLKRLLRRFCKHWIEKRNLLQLAF

SEQ ID NO: 6567 - protein, 43 aa, Artificial Sequence
  Computer-generated peptide variant
KMKLFRRLYRRIPRPSRPALRYKHSKLVKMANKAFNADVAALF

SEQ ID NO: 6568 - protein, 29 aa, Artificial Sequence
  Computer-generated peptide variant
LLKLLHKYMKMMRRDAVRHLKKHDPCGAK

SEQ ID NO: 6569 - protein, 34 aa, Artificial Sequence
  Computer-generated peptide variant
LMKWLHRFIRKLSRAKRAYAEVLSWGAKTKAYAQ

SEQ ID NO: 6570 - protein, 88 aa, Artificial Sequence
  Computer-generated peptide variant
LFKWLRKLIRYIKRLKYYTKQRLQRVMMQWFFMEKQYVARNKSLLLAKYACEHKLRRKGARELRSAAMNQRLAHERACQQKAKKKRLA

SEQ ID NO: 6571 - protein, 20 aa, Artificial Sequence
  Computer-generated peptide variant
WLKMMKKLLRKLPRLPLQAT

SEQ ID NO: 6572 - protein, 61 aa, Artificial Sequence
  Computer-generated peptide variant
WLRMLRKLLRRIRKKDGLYSKIKLKWARIAFGAGGYSAWSNVRVCKRGKARAAQRFLKQEK

SEQ ID NO: 6573 - protein, 92 aa, Artificial Sequence
  Computer-generated peptide variant
KYKFWRRLFKKIKKKWLLDRGRNNNRAKIKETAKLRKNPDLLGMHAAWAHAKRNVAMLTYLAKYLGANKKDLRSLPTLQRKDKIKRWVKKTP

SEQ ID NO: 6574 - protein, 29 aa, Artificial Sequence
  Computer-generated peptide variant
LLKFFRKFLRRWQTFKRLAKAAFADLELM

SEQ ID NO: 6575 - protein, 51 aa, Artificial Sequence
  Computer-generated peptide variant
WLRYWRRILRKFKKPDLALAFKAAFWGAKILGMLRALIKHTYLKGNLKRNI

SEQ ID NO: 6576 - protein, 28 aa, Artificial Sequence
  Computer-generated peptide variant
FLKFYKRMFKRWRSAALCLKLKRVGALR

SEQ ID NO: 6577 - protein, 38 aa, Artificial Sequence
  Computer-generated peptide variant
KLRLWTRIWRRLQKELHLWLVKKKPLRARMWGLACKMM

SEQ ID NO: 6578 - protein, 23 aa, Artificial Sequence
  Computer-generated peptide variant
LLKLIKRWFRLLSKWCKGHLRKM

SEQ ID NO: 6579 - protein, 83 aa, Artificial Sequence
  Computer-generated peptide variant
KLKMLKKYLKWLKTFKLKVCEARQSRKWGRLVLMLRARLLLRYQHHSTDVLGSKLKFVLKPRIKLKAKLWLWERHELFHGRTR

SEQ ID NO: 6580 - protein, 36 aa, Artificial Sequence
  Computer-generated peptide variant
KLRLLTRWLRKFKSGVLLMRMGKGAKITLAALLHKK

SEQ ID NO: 6581 - protein, 56 aa, Artificial Sequence
  Computer-generated peptide variant
KLRMLKRMIKKYPQYMTAEKRLLAIAKALLRKKKAGLVKALCYYKVYRSHFIISVK

SEQ ID NO: 6582 - protein, 48 aa, Artificial Sequence
  Computer-generated peptide variant
FLKMLKRLWKLLNKRALIADKYAAAASKYCKKMTRGACHSILQIKLKQ

SEQ ID NO: 6583 - protein, 62 aa, Artificial Sequence
  Computer-generated peptide variant
LLRFMRKLIRLIKRAKGTKRAKKWELRGAYKRRLKIRSAAKQHHYAFALLMCCLLLRACKDD

SEQ ID NO: 6584 - protein, 34 aa, Artificial Sequence
  Computer-generated peptide variant
LLRLMRKLLRKMKRAWDHSERPRALLPARPCGHS

SEQ ID NO: 6585 - protein, 20 aa, Artificial Sequence
  Computer-generated peptide variant
KFRIFKKLLKKLNCWFQKAA

SEQ ID NO: 6586 - protein, 81 aa, Artificial Sequence
  Computer-generated peptide variant
RLRWLKRIYRKYKNYANRGILKPLTKLRCRTRREPRDLHLELQYKLLAKLPASYWTLAAEMKLHVKLVMQYGALFAKALKN

SEQ ID NO: 6587 - protein, 77 aa, Artificial Sequence
  Computer-generated peptide variant
FFRLMKKLMKYMKKLLYHAKLEKCLHALEKLKMLAGKARAQKKTAVIKWLDRYSCTLRRRVGLAAVAKHHPNKNLRQ

SEQ ID NO: 6588 - protein, 71 aa, Artificial Sequence
  Computer-generated peptide variant
KIKMLTKFMKYIKPRKKRLIRAKCGANKYRCAAKNLLRWACARKQADNLSLLKKWAKLKHAWASQAAACRQ

SEQ ID NO: 6589 - protein, 21 aa, Artificial Sequence
  Computer-generated peptide variant
RLKILRRMFRRFCCRASLSLC

SEQ ID NO: 6590 - protein, 92 aa, Artificial Sequence
  Computer-generated peptide variant
MWKLLHKFLRFIPRRKRANQRAGLTRLAKKAAAKALKQLMYRAMNLMTMDALRLLRITKVQLMRIKPPAPKWKCADHCWKNLTAKAIALLLL

SEQ ID NO: 6591 - protein, 81 aa, Artificial Sequence
  Computer-generated peptide variant
KMKFLSRYMRRFSKEDTLPIKYRKRMTKQIAPLDRRTWALRKAKKRAKLKSWLLCEVWARLLAAKKLTPKAPNGWLPLMKI

SEQ ID NO: 6592 - protein, 47 aa, Artificial Sequence
  Computer-generated peptide variant
FFRFIRKWIKLLRKSTAARCKKGCMAAMFKARFYMKANKADGKLKPA

SEQ ID NO: 6593 - protein, 43 aa, Artificial Sequence
  Computer-generated peptide variant
FLKLIRRLFRRMKKLKMKTAKIINLIRLREPSQFLKTALFHKF

SEQ ID NO: 6594 - protein, 40 aa, Artificial Sequence
  Computer-generated peptide variant
YLRLYRRLWKYLKKASMAVANKKRAKYMCRYTMLVERACI

SEQ ID NO: 6595 - protein, 36 aa, Artificial Sequence
  Computer-generated peptide variant
MWKWWNRLLKRLNRRLYRARLNYAIDWAIDLKLCLL

SEQ ID NO: 6596 - protein, 23 aa, Artificial Sequence
  Computer-generated peptide variant
LLRLFKRFYRYLRRALKLMKLDA

SEQ ID NO: 6597 - protein, 66 aa, Artificial Sequence
  Computer-generated peptide variant
LLRFLSKLLKRMKRKNIRALMLKMALEFAALKKGKKHNLHNLAGAKQANNPTQPKLLDYRDQLATV

SEQ ID NO: 6598 - protein, 42 aa, Artificial Sequence
  Computer-generated peptide variant
IYRLLRRLIKILHNRLFKVRLWYKLLKWVKATKIRVMLKLCR

SEQ ID NO: 6599 - protein, 58 aa, Artificial Sequence
  Computer-generated peptide variant
LMKLLKRFYKKLKKEWALKRPLNGYTRLKLANPQRKSCRVRAWALMAFLKVLDQRTRM

SEQ ID NO: 6600 - protein, 43 aa, Artificial Sequence
  Computer-generated peptide variant
RIKMLKRMLKFWRTKRLAKIKANLMCALAWILRVHNRANNWAL

SEQ ID NO: 6601 - protein, 59 aa, Artificial Sequence
  Computer-generated peptide variant
KMKMYRKIYKRLRRACLSRERKKLRKYNADMAWLRLHLRERNHRKHAAAALAAECLHLW

SEQ ID NO: 6602 - protein, 46 aa, Artificial Sequence
  Computer-generated peptide variant
WFKLMRKFIRYLQRRRLGFCHAAKRREKAWRAKGLLTKVMKAAKAQ

SEQ ID NO: 6603 - protein, 38 aa, Artificial Sequence
  Computer-generated peptide variant
FWKFLKKFLKRLRHGRLCNKTAALFKALKWGKLPDKFL

SEQ ID NO: 6604 - protein, 30 aa, Artificial Sequence
  Computer-generated peptide variant
RFKLFKKLFKWFRPKALMARGAPTKRDAEY

SEQ ID NO: 6605 - protein, 29 aa, Artificial Sequence
  Computer-generated peptide variant
LLKFLKKFLKRFKPTKKNTLDNAREYALY

SEQ ID NO: 6606 - protein, 34 aa, Artificial Sequence
  Computer-generated peptide variant
MLKWLQKWWKKLHSRRILMKRKAMLARCDVYAMK

SEQ ID NO: 6607 - protein, 58 aa, Artificial Sequence
  Computer-generated peptide variant
WYRYYKRMFKWWRRDRWFALRWLGGNARALRAAKISALALHQAQWLFLNAKRKKSKAG

SEQ ID NO: 6608 - protein, 57 aa, Artificial Sequence
  Computer-generated peptide variant
LLKLLTKWLKILKRKFKRCVQRCSKHRAVQICARLVKAQWYPRKLKKSKRHAAAHYH

SEQ ID NO: 6609 - protein, 31 aa, Artificial Sequence
  Computer-generated peptide variant
KLRLLRKIFKKWKHKAPWEARKAASAIHPTS

SEQ ID NO: 6610 - protein, 45 aa, Artificial Sequence
  Computer-generated peptide variant
LLRWLSRLWRILTKCPLQRAEREKMAKKPNQKCRHLLMCKACKPA

SEQ ID NO: 6611 - protein, 45 aa, Artificial Sequence
  Computer-generated peptide variant
RIKFLRKYYKRYNKKKLGDTAKFNADLKRFDGKLMIILAMALQLL

SEQ ID NO: 6612 - protein, 47 aa, Artificial Sequence
  Computer-generated peptide variant
FLKLIPKYMKRFKKKALALRDAQMKRGAMWDSRIKTRTVADLAPLIL

SEQ ID NO: 6613 - protein, 77 aa, Artificial Sequence
  Computer-generated peptide variant
KWKLLPRWYRLWKRPARTDARWKEHTHKPRDPVTLLALDRAALILIASQLFACLRLRLERVLLKQQLALEWHRIRKK

SEQ ID NO: 6614 - protein, 80 aa, Artificial Sequence
  Computer-generated peptide variant
LLKLIKRFLKKLCKRALLGLSATKLPTARDDMLICVGEAPPWGLRPKRLANWRKARTNAAALLLRRRRRSFLGNAEWRGF

SEQ ID NO: 6615 - protein, 54 aa, Artificial Sequence
  Computer-generated peptide variant
RIRIFKKMMRKFRCLMALWWLRVRAMTACKKYGAMAARDRARAAAAESAGKALF

SEQ ID NO: 6616 - protein, 49 aa, Artificial Sequence
  Computer-generated peptide variant
WLKFLKKLFRKLKCTCAAAKMYAGLIFAYFRARRRLERWTNKLILLVKG

SEQ ID NO: 6617 - protein, 48 aa, Artificial Sequence
  Computer-generated peptide variant
RFRLIHKWFKILRHACAMLCFNRRSLRRAERKAIKLVLLNRLGVELRL

SEQ ID NO: 6618 - protein, 21 aa, Artificial Sequence
  Computer-generated peptide variant
RWKLWPRFFRLINKYLLCLRK

SEQ ID NO: 6619 - protein, 31 aa, Artificial Sequence
  Computer-generated peptide variant
WMKLLPRIIRYIRTKYKRHIAAKAAELCLAR

SEQ ID NO: 6620 - protein, 22 aa, Artificial Sequence
  Computer-generated peptide variant
LLKLITRYLKRMSQLIKLRWKL

SEQ ID NO: 6621 - protein, 20 aa, Artificial Sequence
  Computer-generated peptide variant
FFKLMRRFYKKLRQKAFEAL

SEQ ID NO: 6622 - protein, 25 aa, Artificial Sequence
  Computer-generated peptide variant
IYKFLRKYMRKLKRRLGLLAVLMNH

SEQ ID NO: 6623 - protein, 70 aa, Artificial Sequence
  Computer-generated peptide variant
RLKFFRRWLKLFKQIALYLLRHYLKIAAMRRAAWKVSLLDRFRNSNDRGRMPCARKKKEVAELWLKLARR

SEQ ID NO: 6624 - protein, 78 aa, Artificial Sequence
  Computer-generated peptide variant
KMRLFRKYMRKIRRQRLIEGHPKDAPKWECKKQRACAAANIVALKALWAAKWDRFARWLYCQHKWRHMKYLAKRRLNR

SEQ ID NO: 6625 - protein, 55 aa, Artificial Sequence
  Computer-generated peptide variant
LFRLIPRWYRFFKRTTALCAKAYGLKREKLLFLVSLMNKRWILKKSRARVAHRRV

SEQ ID NO: 6626 - protein, 65 aa, Artificial Sequence
  Computer-generated peptide variant
RFKYLTRMYRKLRRSADRNLGKRCRFYRAAHKRLLKARARHRWHILVFVAHSWDSKRWLLWALLN

SEQ ID NO: 6627 - protein, 56 aa, Artificial Sequence
  Computer-generated peptide variant
RLRLMRKIMKWLRKRKGAKKLLLLASQRLCWWDKIAYAMRYNKWLANRKKGAKAYL

SEQ ID NO: 6628 - protein, 40 aa, Artificial Sequence
  Computer-generated peptide variant
IYRLYRRLLKKLNRKHKGKKTLLADAAELHKKNSLARAKK

SEQ ID NO: 6629 - protein, 29 aa, Artificial Sequence
  Computer-generated peptide variant
YFKWLHKLLRRWRHQWRIANLRKNLRSPA

SEQ ID NO: 6630 - protein, 49 aa, Artificial Sequence
  Computer-generated peptide variant
RLKFFKRFLRLMRKWAKRLRRKHLCMTFPLCLDEQLRLKALSASFTCLF

SEQ ID NO: 6631 - protein, 51 aa, Artificial Sequence
  Computer-generated peptide variant
KFKLIRKLLRFMRKFAGGAADANAQAMALVPACNARKCATKKVLCDGNRRK

SEQ ID NO: 6632 - protein, 39 aa, Artificial Sequence
  Computer-generated peptide variant
IFKFFRRMLRRIRCKLLKAATKYQLWKLCKAHNEKLAYN

SEQ ID NO: 6633 - protein, 36 aa, Artificial Sequence
  Computer-generated peptide variant
KYKWLSKWIRRLKRKKQLTRLLIKLLCLNNRLDMSM

SEQ ID NO: 6634 - protein, 28 aa, Artificial Sequence
  Computer-generated peptide variant
KIRLLPKLYRRFTRKDATLRALGYALFM

SEQ ID NO: 6635 - protein, 44 aa, Artificial Sequence
  Computer-generated peptide variant
LYKIIKKLLKFFRRWSRHVKLEAPALIINARWLLLAGDSLRKRT

SEQ ID NO: 6636 - protein, 55 aa, Artificial Sequence
  Computer-generated peptide variant
RLRMWKRLWKLMQHAARTRNFWRRMATIAHYERSLPRMAAALRARAYRREPQRRG

SEQ ID NO: 6637 - protein, 21 aa, Artificial Sequence
  Computer-generated peptide variant
RWKLLNRFWKLFRKAALSMSW

SEQ ID NO: 6638 - protein, 70 aa, Artificial Sequence
  Computer-generated peptide variant
WYRWLSRILKRFKRQAMAKWKACMLLKTFCALVNKKVALCCFLIVTASASSKATARKAAKARKRRLRKKC

SEQ ID NO: 6639 - protein, 28 aa, Artificial Sequence
  Computer-generated peptide variant
FFRLMTRLLRFIRNRRKLGAAKAPLSRR

SEQ ID NO: 6640 - protein, 41 aa, Artificial Sequence
  Computer-generated peptide variant
ILRLLRRFFKRMKKLLLAKKLSFRKTCVLMPSHLKYGALGD

SEQ ID NO: 6641 - protein, 20 aa, Artificial Sequence
  Computer-generated peptide variant
KFKFLRKMYRLMQQALSARA

SEQ ID NO: 6642 - protein, 62 aa, Artificial Sequence
  Computer-generated peptide variant
KYKYWCRMLRRIPKRKLARGRAQGLLKLMAQLAWDPDLKSCKVYTLCAMCAAQKRLRIKLRH

SEQ ID NO: 6643 - protein, 30 aa, Artificial Sequence
  Computer-generated peptide variant
KFKWLHRMLKLWRRALTKQYAAWRTAFKIN

SEQ ID NO: 6644 - protein, 70 aa, Artificial Sequence
  Computer-generated peptide variant
YFKMWNKFYKKMHTRWFRACLRAWGNARREMYKTKLCKKLRQAWAPNLCLKHLIKDRLRKVLLATAKKKL

SEQ ID NO: 6645 - protein, 35 aa, Artificial Sequence
  Computer-generated peptide variant
KYKLMTRLFRLIRQAPRMFLRLLIPKKKLAVLEIS

SEQ ID NO: 6646 - protein, 24 aa, Artificial Sequence
  Computer-generated peptide variant
IIRLFQRFLKKIRRLYLQLNAARH

SEQ ID NO: 6647 - protein, 30 aa, Artificial Sequence
  Computer-generated peptide variant
KMRMYRRLLKRYRTLCGAKACTLDLMKERT

SEQ ID NO: 6648 - protein, 63 aa, Artificial Sequence
  Computer-generated peptide variant
LMKWMRRMFKKYRKVKARLRSTKCLTNKKAAISMALKCSEYEYAGAHKALLHAANRKYQSRAA

SEQ ID NO: 6649 - protein, 29 aa, Artificial Sequence
  Computer-generated peptide variant
KWKFLKRIFRRLQSLAMCAFLAKARAHRR

SEQ ID NO: 6650 - protein, 21 aa, Artificial Sequence
  Computer-generated peptide variant
LIRLWRRWLRMLQQHKAPLHR

SEQ ID NO: 6651 - protein, 78 aa, Artificial Sequence
  Computer-generated peptide variant
RYRLMRRFLRMIRRERNAERPAKWRARARYYGNELIYYAFTALLGWKCLLTAKQNALRELKQKLRHALQPNRLVKSLG

SEQ ID NO: 6652 - protein, 22 aa, Artificial Sequence
  Computer-generated peptide variant
RYKYLSKMWKLFRHKSLRNLLL

SEQ ID NO: 6653 - protein, 43 aa, Artificial Sequence
  Computer-generated peptide variant
RLRLLQKLLRLFRHTCHYRWLARFLVAECVYTLWKAKHLIARK

SEQ ID NO: 6654 - protein, 91 aa, Artificial Sequence
  Computer-generated peptide variant
RLKFLTKLLRKIRKLLWLRWAMAWLRSNKFIPKLLGETALKMSRRSPKRKLKAFARQDPHKAAHVVLTIFPKDLDKIILVQLCWLARRKLK

SEQ ID NO: 6655 - protein, 27 aa, Artificial Sequence
  Computer-generated peptide variant
RFRLLHRWIKLMKKNATANWQAELKMA

SEQ ID NO: 6656 - protein, 23 aa, Artificial Sequence
  Computer-generated peptide variant
FIKLLHKLFRKIRSLEIKAWLAK

SEQ ID NO: 6657 - protein, 33 aa, Artificial Sequence
  Computer-generated peptide variant
RIRYLKRMLRRLKKLRLLLLAGNHVLIYQLRTR

SEQ ID NO: 6658 - protein, 28 aa, Artificial Sequence
  Computer-generated peptide variant
FYKLLKRFWKKIKKTAMRTDLSKEAAGL

SEQ ID NO: 6659 - protein, 41 aa, Artificial Sequence
  Computer-generated peptide variant
RWKLMRRFWKRYKHLADKALLRPALDKRPRRHCPKHMQAAC

SEQ ID NO: 6660 - protein, 60 aa, Artificial Sequence
  Computer-generated peptide variant
LLRIMNRLFRMMRRKLILLRANREMQKLLAYLRTGDKLRDGRKLVITWWLWAYRLHKERY

SEQ ID NO: 6661 - protein, 81 aa, Artificial Sequence
  Computer-generated peptide variant
RIKFIKKLLKILTSQRMRVYTIKYALRLVLRHHRLLYPRDRKGGKKTAALKANNLSHKDAKARQRAKLLSVHKLNTERLFL

SEQ ID NO: 6662 - protein, 26 aa, Artificial Sequence
  Computer-generated peptide variant
LLKYMKKLLRKLTSKAKKNDNEVSLM

SEQ ID NO: 6663 - protein, 40 aa, Artificial Sequence
  Computer-generated peptide variant
KLKLLRKLFRFYKPNQEEWMCWAKNAARCNALVNLKLSLR

SEQ ID NO: 6664 - protein, 59 aa, Artificial Sequence
  Computer-generated peptide variant
KLKYMPRLYRKWRKSFILADYKCNLALFRSTKYSAALCRTRAAWLAQFLCRFWKKLLLA

SEQ ID NO: 6665 - protein, 45 aa, Artificial Sequence
  Computer-generated peptide variant
RLRLLTRLWRRLPRLLLRPRGRLWLAMHLSSKTRHFVLRLKMKWK

SEQ ID NO: 6666 - protein, 47 aa, Artificial Sequence
  Computer-generated peptide variant
KFRLFCKLLRLFNHCKCIMRALIRHKRLLLYHLFARCAYATDCRARK

SEQ ID NO: 6667 - protein, 39 aa, Artificial Sequence
  Computer-generated peptide variant
KLKFFCKMWKRLKKQAEACRNCMMNRKRAARDDASKAAL

SEQ ID NO: 6668 - protein, 33 aa, Artificial Sequence
  Computer-generated peptide variant
KYRFLCRILRKFCCKFWLHLKANLRARPALRRL

SEQ ID NO: 6669 - protein, 55 aa, Artificial Sequence
  Computer-generated peptide variant
RLRFLKRFFKRYCPKLCKKWNIPPAHKLLYERALCAQCLARAMRLENKLKTPKLR

SEQ ID NO: 6670 - protein, 25 aa, Artificial Sequence
  Computer-generated peptide variant
KLKLISRLYKLLRKECLKSQGCAKQ

SEQ ID NO: 6671 - protein, 43 aa, Artificial Sequence
  Computer-generated peptide variant
RFKIIKKILRIFRRLFQLAKPRRARHAAGTLWLIARAYTKFVM

SEQ ID NO: 6672 - protein, 32 aa, Artificial Sequence
  Computer-generated peptide variant
RLKWWSKYMRFFRKFPARCAAMRHTLKANLAL

SEQ ID NO: 6673 - protein, 33 aa, Artificial Sequence
  Computer-generated peptide variant
KMRILRKWLKKLKKAMHAKFTRALQVYACLVSF

SEQ ID NO: 6674 - protein, 35 aa, Artificial Sequence
  Computer-generated peptide variant
MWRLYRKMLKKLNNTIALQRRMRKLAKKAMGPPRL

SEQ ID NO: 6675 - protein, 43 aa, Artificial Sequence
  Computer-generated peptide variant
LLRFLCKLFKRWCHKKDDKRNKAQGLAPGLLKDIMPAARRTTL

SEQ ID NO: 6676 - protein, 20 aa, Artificial Sequence
  Computer-generated peptide variant
KYKLLKRMYRRLHQKLPNHA

SEQ ID NO: 6677 - protein, 29 aa, Artificial Sequence
  Computer-generated peptide variant
FMRLLSRILRKLRKSYPSHMKLLQKEKAP

SEQ ID NO: 6678 - protein, 24 aa, Artificial Sequence
  Computer-generated peptide variant
RLRFMKKLFKFLSKLLTTNKHTAR

SEQ ID NO: 6679 - protein, 25 aa, Artificial Sequence
  Computer-generated peptide variant
YLKFFRRFLRLYRQHDKLMLAFARD

SEQ ID NO: 6680 - protein, 67 aa, Artificial Sequence
  Computer-generated peptide variant
KLRFIKRFYKLLKRGWTAFVARKLRAEARHNKRTLALWRALTYKLEVDAARCRDEAECLNAVFAIRP

SEQ ID NO: 6681 - protein, 40 aa, Artificial Sequence
  Computer-generated peptide variant
MIRWLKKYLRWLSKSKARALGRAHAYDEFAVARKYLRLQD

SEQ ID NO: 6682 - protein, 54 aa, Artificial Sequence
  Computer-generated peptide variant
RFRILKKLLKKLPKRFEPEHERALMKYTSDILQRKGKKRELALHMAPRAPRVHA

SEQ ID NO: 6683 - protein, 76 aa, Artificial Sequence
  Computer-generated peptide variant
KLKFMRRYYKKYRKAAQRVALCRARALHKKPAKGSESRSGLLKKAAPPQGTTRVPIALTRLRRPFDQRLLFMGFLL

SEQ ID NO: 6684 - protein, 27 aa, Artificial Sequence
  Computer-generated peptide variant
RYKMLRRYLRMLRPSLYMKALRLAQVL

SEQ ID NO: 6685 - protein, 23 aa, Artificial Sequence
  Computer-generated peptide variant
KLKLMCRWLKMLRSLLQLEDSGK

SEQ ID NO: 6686 - protein, 55 aa, Artificial Sequence
  Computer-generated peptide variant
MLRWWPRFIRKLPKRTPKRLEALLWRLLADLCQRAIGRDAKALNMLWCSKVVKKL

SEQ ID NO: 6687 - protein, 41 aa, Artificial Sequence
  Computer-generated peptide variant
FLKLIRRYFRRFKRHSNSNKAREAAYFAKKALKGAKILAPM

SEQ ID NO: 6688 - protein, 54 aa, Artificial Sequence
  Computer-generated peptide variant
KLKLFKKLLRYFQKLWMYLFRRAARLWCAELACGALWLFLLKARLMQKIKRKHA

SEQ ID NO: 6689 - protein, 23 aa, Artificial Sequence
  Computer-generated peptide variant
KFRYYKRFLKFMNKELAAAAVNL

SEQ ID NO: 6690 - protein, 43 aa, Artificial Sequence
  Computer-generated peptide variant
LFKLLNKWIKKFRKKMLERDKKPRMPTTLKNLAHVKLAFWRAY

SEQ ID NO: 6691 - protein, 91 aa, Artificial Sequence
  Computer-generated peptide variant
RLRFFQRWMRRYQKVAWYKAACKELAAAVGKAKARCPKKLARWAKFKSWQPLMIKAYRLPARRKKRRFAIQSRAWWLVKGMLSRRCKQLLR

SEQ ID NO: 6692 - protein, 33 aa, Artificial Sequence
  Computer-generated peptide variant
KLKFMKRILRKMHNLMTLNADLKKKKLNKAFHD

SEQ ID NO: 6693 - protein, 47 aa, Artificial Sequence
  Computer-generated peptide variant
RLKLLRRFLRKFKNLAMERHKCNRKRQLWRHLSFAASCLGKARWAAR

SEQ ID NO: 6694 - protein, 20 aa, Artificial Sequence
  Computer-generated peptide variant
RLKLLPKYLKMMKKDIHMAK

SEQ ID NO: 6695 - protein, 28 aa, Artificial Sequence
  Computer-generated peptide variant
RLKYFRRLWRYLKRKLYLDWFWAARCAL

SEQ ID NO: 6696 - protein, 21 aa, Artificial Sequence
  Computer-generated peptide variant
WLRLLQKMYRMINTKLLRRSA

SEQ ID NO: 6697 - protein, 21 aa, Artificial Sequence
  Computer-generated peptide variant
MFRLFKRILRLLRHRQLASRD

SEQ ID NO: 6698 - protein, 27 aa, Artificial Sequence
  Computer-generated peptide variant
FYKLFKRLLKWYTKAAARRGKANAAYV

SEQ ID NO: 6699 - protein, 87 aa, Artificial Sequence
  Computer-generated peptide variant
KLRFIKRLFRKFPHLVARRKNTRKLETASLLLPNMKYREDLIFYKLRQGGKAAKAKDLITAFKSRNAALACKTKQHIDALAPAVLRL

SEQ ID NO: 6700 - protein, 30 aa, Artificial Sequence
  Computer-generated peptide variant
LMRLLRRYLKMWRSAMLWAKTAHKQVEAPL

SEQ ID NO: 6701 - protein, 29 aa, Artificial Sequence
  Computer-generated peptide variant
KWRLLHKMWRRFRKAKLFALPTLVARFNR

SEQ ID NO: 6702 - protein, 25 aa, Artificial Sequence
  Computer-generated peptide variant
IYKWLSRYLRRFPTPKLKAAANADK

SEQ ID NO: 6703 - protein, 41 aa, Artificial Sequence
  Computer-generated peptide variant
MYRLIRKLLRLFPKALKFLMTLYLKKDKRPRHKDERARCQY

SEQ ID NO: 6704 - protein, 23 aa, Artificial Sequence
  Computer-generated peptide variant
IWRYLPRLYRKWRKKLSLMPLLS

SEQ ID NO: 6705 - protein, 57 aa, Artificial Sequence
  Computer-generated peptide variant
KLRLLRRMWRRMRRSALAQRRKWELANWTLCSRKWDLKNRWWASLWRQHKKDAAHVL

SEQ ID NO: 6706 - protein, 29 aa, Artificial Sequence
  Computer-generated peptide variant
RMRLLQRLWKRYRKALDQKYHLLRHYMLL

SEQ ID NO: 6707 - protein, 100 aa, Artificial Sequence
  Computer-generated peptide variant
LIRLWRKIIKIFKPHQKLKYGAKLLLMTTATYRTKPARALTSFADKLFLYFLQRKFEYAAAKRGRRPRCAANLCKLKRTRKNEPQAAKDKLKYLGLLNNY

SEQ ID NO: 6708 - protein, 43 aa, Artificial Sequence
  Computer-generated peptide variant
RLKLYKKFFRKFTRQDRKQLNHLLLLAFKRAMMPLARAWSAIK

SEQ ID NO: 6709 - protein, 30 aa, Artificial Sequence
  Computer-generated peptide variant
KLRILSRLWRKLSRLALKIKIGFIAKELAA

SEQ ID NO: 6710 - protein, 65 aa, Artificial Sequence
  Computer-generated peptide variant
KLRMFRRIMKFLKRMLALAQHFKFNAARRAVCRVLKCLRLLAMKQYLPRKCHLDRIWNRKAMYHK

SEQ ID NO: 6711 - protein, 38 aa, Artificial Sequence
  Computer-generated peptide variant
KLKFLRKLYRLLCPLSISYRPHKRLRANAGHLARCCLH

SEQ ID NO: 6712 - protein, 75 aa, Artificial Sequence
  Computer-generated peptide variant
YFKLYKRLFRLYRRMACPKLVAKLPWLAMKMNQSGRKTARSHAQDAADCRTLRFGILKCLRLRRCRLVLKRPRLR

SEQ ID NO: 6713 - protein, 33 aa, Artificial Sequence
  Computer-generated peptide variant
RFKFLKKYMKRLNHALNCQQKARLKYSHAAILL

SEQ ID NO: 6714 - protein, 32 aa, Artificial Sequence
  Computer-generated peptide variant
KFRLLQRMLKKLRQFAAKWFKKTECQLQAAQK

SEQ ID NO: 6715 - protein, 85 aa, Artificial Sequence
  Computer-generated peptide variant
KLKFLRKILRKIHKGNWNRWRKARGKLAYRLKKWCFVRPRCRASAKRCKWATLRSLIYDKLDCTNALCLCTKSNKLKAAQLPGAM

SEQ ID NO: 6716 - protein, 26 aa, Artificial Sequence
  Computer-generated peptide variant
FMKLWQKYLKRLRQAWLRHLKTGLFR

SEQ ID NO: 6717 - protein, 74 aa, Artificial Sequence
  Computer-generated peptide variant
RMRLIRRLLRKYCNTKAGAVKMALALHFKMRARTSNKKELCGARDKRKNLQHIAGYAALLHKPLKHCAAICAPR

SEQ ID NO: 6718 - protein, 88 aa, Artificial Sequence
  Computer-generated peptide variant
KLRWMKKFYRLLRQRWRCGCKRKKCSDKDRTRSDWRLERLKMDALARRLMLICWPMKKLADDRFARAALKKKWPASSAHRALQLMKLE

SEQ ID NO: 6719 - protein, 23 aa, Artificial Sequence
  Computer-generated peptide variant
KIRYYRKWLKLFNKAHLRARIAA

SEQ ID NO: 6720 - protein, 56 aa, Artificial Sequence
  Computer-generated peptide variant
KLRFLRKWIRLWQKQAKDDHALHRAPRLMKKKYRNLKVAPFRRWKLEAKKALAFMT

SEQ ID NO: 6721 - protein, 29 aa, Artificial Sequence
  Computer-generated peptide variant
LWKMLKKMLRYFSRERHKARCAATFLPRH

SEQ ID NO: 6722 - protein, 22 aa, Artificial Sequence
  Computer-generated peptide variant
LMRFLTRFLRKLRRVACAAWIS

SEQ ID NO: 6723 - protein, 61 aa, Artificial Sequence
  Computer-generated peptide variant
YFKLYHRMMKKLCRAALYKCLCLEKKYTLSGELQLLLMARAEKVRACRALLRKKNAQRDRD

SEQ ID NO: 6724 - protein, 55 aa, Artificial Sequence
  Computer-generated peptide variant
FLKLFKKWLKKLRRWARLDASAQNVQCARLQLHHWKARRQAAVKAELKELWSQWI

SEQ ID NO: 6725 - protein, 34 aa, Artificial Sequence
  Computer-generated peptide variant
LFRWLRKFIKRLKKRLWLALLAKDKTIFLYMPWK

SEQ ID NO: 6726 - protein, 32 aa, Artificial Sequence
  Computer-generated peptide variant
FWRLIHKMLRRFKRLRKASADELNKHASLRRV

SEQ ID NO: 6727 - protein, 27 aa, Artificial Sequence
  Computer-generated peptide variant
RMKMLHKYFKWMQRSLGKATYRAALLR

SEQ ID NO: 6728 - protein, 20 aa, Artificial Sequence
  Computer-generated peptide variant
YLRLLQRFLKKINRPYALAR

SEQ ID NO: 6729 - protein, 20 aa, Artificial Sequence
  Computer-generated peptide variant
RFKLMSKYWRLYQRLKRLAY

SEQ ID NO: 6730 - protein, 54 aa, Artificial Sequence
  Computer-generated peptide variant
LIRFWKRLMRIMRRKANFAACEKLKYNRCIKQRKHNAVAERACLKALVWVRRLL

SEQ ID NO: 6731 - protein, 25 aa, Artificial Sequence
  Computer-generated peptide variant
FLRILRKFLRKMCKTARAWKALPAI

SEQ ID NO: 6732 - protein, 34 aa, Artificial Sequence
  Computer-generated peptide variant
RWKYMCRWFRKLTPRCNIALLCAERRAMANLRLL

SEQ ID NO: 6733 - protein, 31 aa, Artificial Sequence
  Computer-generated peptide variant
YMKLYKRFYRKLKCAAAIRRYRKKDLGDYLA

SEQ ID NO: 6734 - protein, 40 aa, Artificial Sequence
  Computer-generated peptide variant
KLRWLKKLMKRLKKNCVRLKKPHCCLEMFAACSRKFASAP

SEQ ID NO: 6735 - protein, 91 aa, Artificial Sequence
  Computer-generated peptide variant
RMKFMSRLFRRMRQKRPRLAVRKMRARALVDHLAQKSCKRMALKKRKGKVRWLAECDVARSVAAKADSRLVYDKAWVAALALTCLTIIKFD

SEQ ID NO: 6736 - protein, 28 aa, Artificial Sequence
  Computer-generated peptide variant
RFRLMPRLLRRIRRRCGTLMLRQSPAAL

SEQ ID NO: 6737 - protein, 91 aa, Artificial Sequence
  Computer-generated peptide variant
MLRIFKRLFKKYKQRRPEACKKKMLRAAFPNAALYITKKFAKRLKDPMRPKKAAGSQERAKGAKTLPFRRMHLLLRSLYKSAGWPRSLWAS

SEQ ID NO: 6738 - protein, 50 aa, Artificial Sequence
  Computer-generated peptide variant
RLKLFRKILKKFRRQCCRSHQKNADAISKRFCLAHADAWKAVKKLGKTAF

SEQ ID NO: 6739 - protein, 78 aa, Artificial Sequence
  Computer-generated peptide variant
RLRFLRRLFKFYKKALNAISKWRVFDYVAAKLRKRLAGTKQDALHRSRWVSVNIRIALDAYKLFAQRKRRMVRYAIVR

SEQ ID NO: 6740 - protein, 73 aa, Artificial Sequence
  Computer-generated peptide variant
KLRIFRRLLKRMPKGYTRGAERHAHKAKPAGAAQEPRKSRTRFNGRRCPAACLDILAKRAWRLQRRFRKKWAA

SEQ ID NO: 6741 - protein, 36 aa, Artificial Sequence
  Computer-generated peptide variant
LFKLFHRYWRLWKTAALGDKLRTQERAVAYRPLKKQ

SEQ ID NO: 6742 - protein, 29 aa, Artificial Sequence
  Computer-generated peptide variant
RLKMWCRWFRRLRKTGLPAVRPDRLPAAQ

SEQ ID NO: 6743 - protein, 45 aa, Artificial Sequence
  Computer-generated peptide variant
KIKMLKRFMKRLKSALADLRHKLDKKLLLPKNLAKKRMVAVLAQA

SEQ ID NO: 6744 - protein, 62 aa, Artificial Sequence
  Computer-generated peptide variant
LFKLYKKLLRFWRKPAYFERKEANLAGSAIAKLAKVIWATWRYKLRRKLAPKCAIMKTAVER

SEQ ID NO: 6745 - protein, 35 aa, Artificial Sequence
  Computer-generated peptide variant
KIRWYKKWLRRLRPAHARWLCNMCLAKFLLLEREW

SEQ ID NO: 6746 - protein, 47 aa, Artificial Sequence
  Computer-generated peptide variant
IIKWFNKLLKRWHNPLWNPINREKNLKEDALSRRARAALGLRRRRLA

SEQ ID NO: 6747 - protein, 53 aa, Artificial Sequence
  Computer-generated peptide variant
LFRFLRKLLKFLKRSLRRNVYLIRLPYMKENFFKQFLAIKRALADTMKYSRKK

SEQ ID NO: 6748 - protein, 62 aa, Artificial Sequence
  Computer-generated peptide variant
KLRMMKRFLRMLRKNRWAMRLWPFAVLLLLWMLKAKRGAALRRRAWWEHWFLHAHPFNGRRL

SEQ ID NO: 6749 - protein, 35 aa, Artificial Sequence
  Computer-generated peptide variant
RLRFWKRMLKKWQRPFRRAKSFPALAIAGLLITKP

SEQ ID NO: 6750 - protein, 35 aa, Artificial Sequence
  Computer-generated peptide variant
LLRLYHRLFKKWRKTQLLQFKHKMLPKRAINWRLL

SEQ ID NO: 6751 - protein, 22 aa, Artificial Sequence
  Computer-generated peptide variant
KYRFLNKLLRKLSKKVKAYAVA

SEQ ID NO: 6752 - protein, 80 aa, Artificial Sequence
  Computer-generated peptide variant
LLKYIRRYYRYLRKHDLRKTQMAAAFLPRKLAAKMDLVCATDLWWSSLRVNVLAAMAALLRKKHLERKSKKLNTFLARPM

SEQ ID NO: 6753 - protein, 37 aa, Artificial Sequence
  Computer-generated peptide variant
RMRLFKRMIRKLTKWSKHHKAGGALLLDKLILAHIKQ

SEQ ID NO: 6754 - protein, 46 aa, Artificial Sequence
  Computer-generated peptide variant
FIRLWRKFMRKYRQAKMNTLERKLLAIRILAVKNVYAYLAMSLKAR

SEQ ID NO: 6755 - protein, 26 aa, Artificial Sequence
  Computer-generated peptide variant
FWKLLRRFFRWLNKSHDKRAVKILLA

SEQ ID NO: 6756 - protein, 47 aa, Artificial Sequence
  Computer-generated peptide variant
FLKLIKRFIKRLRRTCPIIRRRLRHEKLYCALKRAWAGHSHANLAAT

SEQ ID NO: 6757 - protein, 55 aa, Artificial Sequence
  Computer-generated peptide variant
LLKLFPKWMRLMKSATAAKRKPGGRPLRLRKQVWGALRASAMALQLKSQMKKGSA

SEQ ID NO: 6758 - protein, 41 aa, Artificial Sequence
  Computer-generated peptide variant
KLKILKRFWRLFNQRSQARKFDEWKLMTRAWILCARLRIKL

SEQ ID NO: 6759 - protein, 67 aa, Artificial Sequence
  Computer-generated peptide variant
KIKIIRRMLRKWNKMPYGQRSGRGKYWRDRAAAARKFALWYDFLLIQKAKALKARPKQPWLKQAKLP

SEQ ID NO: 6760 - protein, 52 aa, Artificial Sequence
  Computer-generated peptide variant
IYRMFKRLFKRLRHYKGMYKAHLALRRRYGPLEAMFDLLLATRRYGGLALRL

SEQ ID NO: 6761 - protein, 20 aa, Artificial Sequence
  Computer-generated peptide variant
YLRLICRLIKKLTCLWDLKR

SEQ ID NO: 6762 - protein, 68 aa, Artificial Sequence
  Computer-generated peptide variant
RYRLMNKFWRILRRLFRQAMEAKLETAAPHGVWEWKRHLKKRKMRLRCAAADKLYKQRKRACILAIAK

SEQ ID NO: 6763 - protein, 36 aa, Artificial Sequence
  Computer-generated peptide variant
LWRFLNRWIRLFRNLRIRDEHPKPLMASKVARKAAA

SEQ ID NO: 6764 - protein, 40 aa, Artificial Sequence
  Computer-generated peptide variant
YFKFWKKFWRLLRKGDGAMWKLRKRLANLATARRIAMQMP

SEQ ID NO: 6765 - protein, 23 aa, Artificial Sequence
  Computer-generated peptide variant
LYRLLRKFLKLFPRHYVTLAKWT

SEQ ID NO: 6766 - protein, 90 aa, Artificial Sequence
  Computer-generated peptide variant
RYKYMQKWLKKWKKAGILLKLHLIALFQNRKAARKDQLKLAAKLRGWTKRMLRKRKVGLQHGWAVKVLKLAVIANREFSAEKKVYLKNCK

SEQ ID NO: 6767 - protein, 40 aa, Artificial Sequence
  Computer-generated peptide variant
YIKLLRRLIKKMPKLYFRKTEYLNMAWNSNAARLRLRQRS

SEQ ID NO: 6768 - protein, 20 aa, Artificial Sequence
  Computer-generated peptide variant
LFKLYRRILKMFQRLEKARA

SEQ ID NO: 6769 - protein, 33 aa, Artificial Sequence
  Computer-generated peptide variant
IIKLLRKLWRKLRHLLAAKLRGKKLMQTRFRRE

SEQ ID NO: 6770 - protein, 50 aa, Artificial Sequence
  Computer-generated peptide variant
KFRFLNKFFKKFRCRLLYKMRFLLNRIALRKIRDLKLAKKLLYRPSHTRL

SEQ ID NO: 6771 - protein, 48 aa, Artificial Sequence
  Computer-generated peptide variant
KFKFLSRWYRKMKRALAEFFLALHSTLMRRSFRTKLEDAKRDGAKAIL

SEQ ID NO: 6772 - protein, 32 aa, Artificial Sequence
  Computer-generated peptide variant
MFRLIRRLLKKLRSTYRLLKKCALHEWAVMML

SEQ ID NO: 6773 - protein, 46 aa, Artificial Sequence
  Computer-generated peptide variant
KIKWLRKLLRYITKCIARFLLLAMYLLKQAKTKKPIKVGRMALHQK

SEQ ID NO: 6774 - protein, 61 aa, Artificial Sequence
  Computer-generated peptide variant
WIKFLRRLLRLMKSASRVKKHGRAKPAVLLGAQAIGVAFWRIQVIDCRKKKRLIVLLKAAN

SEQ ID NO: 6775 - protein, 54 aa, Artificial Sequence
  Computer-generated peptide variant
KLKIIKRMLKLINRRRCEIEEARFRRAAHLRFCRLHRAVLRHTMLALREATHKK

SEQ ID NO: 6776 - protein, 26 aa, Artificial Sequence
  Computer-generated peptide variant
RLRIFHKFIRLFCRLATRKLCELLLK

SEQ ID NO: 6777 - protein, 50 aa, Artificial Sequence
  Computer-generated peptide variant
KLKILSKLLKILNKTKKLDYKLLLAIMARRKKKVFKKVWIPIKKALKECG

SEQ ID NO: 6778 - protein, 61 aa, Artificial Sequence
  Computer-generated peptide variant
IMKLMRKFWKRYRKLTCLLFTKTERMHLAERKHARAILLAPYKAAHLLKHQAELDGPKKAA

SEQ ID NO: 6779 - protein, 23 aa, Artificial Sequence
  Computer-generated peptide variant
KFKILSKFLRMYNRLGRLKLEAR

SEQ ID NO: 6780 - protein, 46 aa, Artificial Sequence
  Computer-generated peptide variant
MMRMMKRLIRRLCRYKVRTHAFVASRHADAADAPIKWRKRLRTLKL

SEQ ID NO: 6781 - protein, 40 aa, Artificial Sequence
  Computer-generated peptide variant
KLKIWKRLFRIIRSHLAKNHAFMHKAIANVTHAKLRRKML

SEQ ID NO: 6782 - protein, 70 aa, Artificial Sequence
  Computer-generated peptide variant
RLKYFKKLWKFIKKKFAREMNAAALSVNQLLKQLHRTAAAKAWRNRALCKIKWCLRKRWLYAQHRAWGGP

SEQ ID NO: 6783 - protein, 57 aa, Artificial Sequence
  Computer-generated peptide variant
KIKFWRRFLKRLKNKTHMAALLPANLAASFALLASMRCLCHKKCMRAKYKSAFAEAV

SEQ ID NO: 6784 - protein, 43 aa, Artificial Sequence
  Computer-generated peptide variant
MFRMMCKWLRFWHKKYKLRHALLAHRHLFLWCARKFARKDKCK

SEQ ID NO: 6785 - protein, 31 aa, Artificial Sequence
  Computer-generated peptide variant
RWRIWCKLLKKLKRNAARKKASAGDCFMADI

SEQ ID NO: 6786 - protein, 69 aa, Artificial Sequence
  Computer-generated peptide variant
RLKLFTKYMKRFRKPRHMLRVLHLLKADLHWKRADWDLMTLRCLMKKYRRADIGNARVNHLCRLARRCS

SEQ ID NO: 6787 - protein, 50 aa, Artificial Sequence
  Computer-generated peptide variant
RIKWYNRLWRYMKTKKELYARMRLRLLLLSHKLDRTKCLRAQIEAQKLNR

SEQ ID NO: 6788 - protein, 39 aa, Artificial Sequence
  Computer-generated peptide variant
KFRIMRKLYRLYRKKWWFRGFRLALPHLATYKQAHANAK

SEQ ID NO: 6789 - protein, 28 aa, Artificial Sequence
  Computer-generated peptide variant
RLRMWPKLLKLLPRAWNAAVKGLHRQIH

SEQ ID NO: 6790 - protein, 64 aa, Artificial Sequence
  Computer-generated peptide variant
RLKLYKRILRKLNRAKLKDWRACRKDVGSYLDSFALAASSLRLAVLSKRWRYAPTSHLCFKSAK

SEQ ID NO: 6791 - protein, 22 aa, Artificial Sequence
  Computer-generated peptide variant
RLRFLKRWLRRWCRCAVRAKLA

SEQ ID NO: 6792 - protein, 40 aa, Artificial Sequence
  Computer-generated peptide variant
KLRMMKKLFRMLTQLKLRDFALMRKKWCIKEKLCLELYQL

SEQ ID NO: 6793 - protein, 45 aa, Artificial Sequence
  Computer-generated peptide variant
KLRLLPKMFRKLRSALWRRTSDMMAILGRARAKNSRRSAKAKRGE

SEQ ID NO: 6794 - protein, 37 aa, Artificial Sequence
  Computer-generated peptide variant
LLRFLRRWWKWMKRYAALSALHKRPFMTRHFIARHLL

SEQ ID NO: 6795 - protein, 73 aa, Artificial Sequence
  Computer-generated peptide variant
RWKLWCRLMKRMKRAWQQHALTMKLRKIRHRWIMRLRARHLRARPRAKVALYAYWLAALKIMFFQFRLHAQRC

SEQ ID NO: 6796 - protein, 39 aa, Artificial Sequence
  Computer-generated peptide variant
KYRLWHRLWRFLPPSLAAKARRALDFMNKKALRRAGTRA

SEQ ID NO: 6797 - protein, 46 aa, Artificial Sequence
  Computer-generated peptide variant
KWRWLTKLLRLLKKTALASARGLRTPRMEPVHLYQAYHKRCAMKML

SEQ ID NO: 6798 - protein, 22 aa, Artificial Sequence
  Computer-generated peptide variant
KYKWWKRLLRFLRPARAPCAKF

SEQ ID NO: 6799 - protein, 36 aa, Artificial Sequence
  Computer-generated peptide variant
RLRFFKKFYKKFPRRLALAALCDRPFKLFRGWDHHL

SEQ ID NO: 6800 - protein, 48 aa, Artificial Sequence
  Computer-generated peptide variant
RWRWYPRLYKRLKRHHKCGVKLAYIFMACPKLLWDKLLNKKAQLLLYL

SEQ ID NO: 6801 - protein, 20 aa, Artificial Sequence
  Computer-generated peptide variant
RLKFLKRWLRRLKCFLHFNI

SEQ ID NO: 6802 - protein, 65 aa, Artificial Sequence
  Computer-generated peptide variant
RYRLLQKIFRLWNRSVKLRCDKTNRCKLYCAALLTKLALKANLSKKALRYKADLKQRNEKHFAFD

SEQ ID NO: 6803 - protein, 43 aa, Artificial Sequence
  Computer-generated peptide variant
MLRWLKRWMRLFKRAIKNQQSEAHAMALAAMLKINAKLKNHPL

SEQ ID NO: 6804 - protein, 38 aa, Artificial Sequence
  Computer-generated peptide variant
KFRWLKRLLRLLPRAMREDMAKVQRPHMPRALWKDMMR

SEQ ID NO: 6805 - protein, 55 aa, Artificial Sequence
  Computer-generated peptide variant
KLRMLPKWWRRYCQALLSLKGLMRPADALGCRAAKMKGMILRRPRYDLAKKCWAR

SEQ ID NO: 6806 - protein, 44 aa, Artificial Sequence
  Computer-generated peptide variant
KMKMLRKFFRFYHSKDGNMRAMLRAALFLLLRIAMRYKQKLTRL

SEQ ID NO: 6807 - protein, 23 aa, Artificial Sequence
  Computer-generated peptide variant
LLKYFCKFLKKLKKAHVLKRADL

SEQ ID NO: 6808 - protein, 20 aa, Artificial Sequence
  Computer-generated peptide variant
KLKLFPKLFRFMQRLLCFKQ

SEQ ID NO: 6809 - protein, 81 aa, Artificial Sequence
  Computer-generated peptide variant
RIKFLTKLLKYLTKNRHNLARRLKQRDALLWLNDVLTFPAPWRMKRKLLQKYLLDAKGRDLNRLPVCAAVSHKRRSLGNRA

SEQ ID NO: 6810 - protein, 63 aa, Artificial Sequence
  Computer-generated peptide variant
KLRMIKRLLKMLPSLANINHLRQLVQCEKRKRDSKLAAKARLNRYRAREKMIAVLRRRDAWKA

SEQ ID NO: 6811 - protein, 67 aa, Artificial Sequence
  Computer-generated peptide variant
WFRLLRKFWKILRRWLKKEKADQRPMKAEVLAMARNKVQKPQLICAALWKFSRNLAAKKLGRMFSAN

SEQ ID NO: 6812 - protein, 53 aa, Artificial Sequence
  Computer-generated peptide variant
MWKFMRKLIRKIKRAKKHQMRCLLLGYMMAKRGTILRALKTGRASKRADAAYM

SEQ ID NO: 6813 - protein, 23 aa, Artificial Sequence
  Computer-generated peptide variant
WIRFLKKLIKRFRRLAKWVANEA

SEQ ID NO: 6814 - protein, 59 aa, Artificial Sequence
  Computer-generated peptide variant
ILRLFKKLWRRFRRAPWIASQLAIEMRLAKKLGATTVRHWGASAKTWRWKRLLYAFAWL

SEQ ID NO: 6815 - protein, 45 aa, Artificial Sequence
  Computer-generated peptide variant
RWKFLCKFWKFFRKRFPVAAILAAKLQSMKTLRHKYAKKKSEAAK

SEQ ID NO: 6816 - protein, 30 aa, Artificial Sequence
  Computer-generated peptide variant
RFRLLKKLFRKLKHAKPLFAFATCGAKAVS

SEQ ID NO: 6817 - protein, 51 aa, Artificial Sequence
  Computer-generated peptide variant
LMRFMRRMWKLLCKEAIALKHYAAQKKRRAYAAKAYISALTELLRGYARRA

SEQ ID NO: 6818 - protein, 36 aa, Artificial Sequence
  Computer-generated peptide variant
FFKFLRRLLRKLRTCLVITMGLLRRTKLYRVLTLRA

SEQ ID NO: 6819 - protein, 52 aa, Artificial Sequence
  Computer-generated peptide variant
YLKYLRKYMRLLRKLKNKKDKAIKQAWIHLEKALKWRGPNRFIFLYFKPATL

SEQ ID NO: 6820 - protein, 32 aa, Artificial Sequence
  Computer-generated peptide variant
KIRLFRKFLRYLHKANKLPAIGKLSGRVKLSK

SEQ ID NO: 6821 - protein, 40 aa, Artificial Sequence
  Computer-generated peptide variant
RLRIICKFFRKLKKKAKAPVCCRLANLALSYGLFWLRTNI

SEQ ID NO: 6822 - protein, 38 aa, Artificial Sequence
  Computer-generated peptide variant
RMRYLHKLLRYFKCAEWHLAALFCKCLRIELRMFKWAR

SEQ ID NO: 6823 - protein, 43 aa, Artificial Sequence
  Computer-generated peptide variant
KYKYLPRFLRIYTTKTNYLKRAGIEWKRFLRAAHTLNKAALKA

SEQ ID NO: 6824 - protein, 21 aa, Artificial Sequence
  Computer-generated peptide variant
FFKLLKRLYKLLQRRAPLYRV

SEQ ID NO: 6825 - protein, 45 aa, Artificial Sequence
  Computer-generated peptide variant
RMRFYKRLLRLFTRLLLLRMHMVKARAQKVGMNQRLANEAKYGQR

SEQ ID NO: 6826 - protein, 31 aa, Artificial Sequence
  Computer-generated peptide variant
MMKILNRLLKKWRRLFNAAKYRLRTYALFRE

SEQ ID NO: 6827 - protein, 21 aa, Artificial Sequence
  Computer-generated peptide variant
FLKLFTKILRRLNRLLQRTMD

SEQ ID NO: 6828 - protein, 20 aa, Artificial Sequence
  Computer-generated peptide variant
KLRLLRRLLKFMKCRSAHFQ

SEQ ID NO: 6829 - protein, 30 aa, Artificial Sequence
  Computer-generated peptide variant
FLRLLRRLWRKMRPALRPFRQALFRATCIF

SEQ ID NO: 6830 - protein, 23 aa, Artificial Sequence
  Computer-generated peptide variant
FFRLLKKYLKKITKFADLLGRLT

SEQ ID NO: 6831 - protein, 26 aa, Artificial Sequence
  Computer-generated peptide variant
KIRILRKLLRKLKNFNATAWAKWKKL

SEQ ID NO: 6832 - protein, 66 aa, Artificial Sequence
  Computer-generated peptide variant
LYRFMKKLWKLYHKLDRRTCMAGRRRARLLAYIEANKLAVLLYPQLDATLEKQKRKKKMRYTRHTF

SEQ ID NO: 6833 - protein, 29 aa, Artificial Sequence
  Computer-generated peptide variant
YIKILKRYLRWLRRDLLVCWKAPARNRAS

SEQ ID NO: 6834 - protein, 30 aa, Artificial Sequence
  Computer-generated peptide variant
KLKLFRRLLKKWTHKLKHRATIFLSAIRLK

SEQ ID NO: 6835 - protein, 44 aa, Artificial Sequence
  Computer-generated peptide variant
MIRYFKKLIKRITRQKYGCERARAIIKKYLTRAAALERCARLLN

SEQ ID NO: 6836 - protein, 29 aa, Artificial Sequence
  Computer-generated peptide variant
LLKLMRKILKLFHKTASKQRCILDAILWP

SEQ ID NO: 6837 - protein, 34 aa, Artificial Sequence
  Computer-generated peptide variant
RWKFFRRFYRLWRKKFWLLVKPKALEKLDAILEG

SEQ ID NO: 6838 - protein, 26 aa, Artificial Sequence
  Computer-generated peptide variant
LLKMFQKLFRRLSKIRRSEKCYAAAW

SEQ ID NO: 6839 - protein, 38 aa, Artificial Sequence
  Computer-generated peptide variant
ILKFFCRFLRKMQKKDLLFRRLSFWKETYLKLLARFLN

SEQ ID NO: 6840 - protein, 52 aa, Artificial Sequence
  Computer-generated peptide variant
RLKFMRRILKRFKCIEAGILVQAARKVSKAAALRREGWQMLGLKIKSRAKLQ

SEQ ID NO: 6841 - protein, 21 aa, Artificial Sequence
  Computer-generated peptide variant
RMKFLRRFFKRWTKQALLHLL

SEQ ID NO: 6842 - protein, 81 aa, Artificial Sequence
  Computer-generated peptide variant
RLRFFQRMFKRIKKWKAPKEGQAPILCLLRAEAWTAYALRLARGDSGRLKKNRAKQNCLTHKCEAVKAQKKDKGFRRRAKL

SEQ ID NO: 6843 - protein, 32 aa, Artificial Sequence
  Computer-generated peptide variant
KLRLIRRLIKLFKKHLDLTLAFKLWLKKALTH

SEQ ID NO: 6844 - protein, 26 aa, Artificial Sequence
  Computer-generated peptide variant
KLRLLSRMIRRLKKLFRAREPVANTQ

SEQ ID NO: 6845 - protein, 70 aa, Artificial Sequence
  Computer-generated peptide variant
KFRLFRRYMKIYQRKDLRAKSLKAGVAAAYKKRLVLRKGAWFKIFAPWRLAIKLRQFDYAARAFFMLCLI

SEQ ID NO: 6846 - protein, 38 aa, Artificial Sequence
  Computer-generated peptide variant
MLRFFSKLLKRLRPEMLQMLAKKLLYSQNRLSRRTSLL

SEQ ID NO: 6847 - protein, 83 aa, Artificial Sequence
  Computer-generated peptide variant
MFKIIKKYWKWMKSAKRCPCDDALRHDLIKAKAQKTRQGWCPAKKVKRLLITFVRELEKRAYLRKALLRKFFQALLLASELAK

SEQ ID NO: 6848 - protein, 58 aa, Artificial Sequence
  Computer-generated peptide variant
MWKLLHKLFRRFSKHWTADVRKKRGLADEYFKLRAYKRVRLRKAKGLCEAAKAVSDIN

SEQ ID NO: 6849 - protein, 29 aa, Artificial Sequence
  Computer-generated peptide variant
LLRIFKKLYKFIRCTSYLPAKRWKATKQA

SEQ ID NO: 6850 - protein, 49 aa, Artificial Sequence
  Computer-generated peptide variant
FIRLIPKIYKYLHKFGYWTWALLARPRDWRLEALLLTKACLLKADRKVK

SEQ ID NO: 6851 - protein, 39 aa, Artificial Sequence
  Computer-generated peptide variant
LLKWLRKFLRKWKCAADAANFRNYKAKWKKLDSNRVKNM

SEQ ID NO: 6852 - protein, 36 aa, Artificial Sequence
  Computer-generated peptide variant
KWRFLTKLYKKFSRRPKLLPRVNALDKSVAIQKALS

SEQ ID NO: 6853 - protein, 62 aa, Artificial Sequence
  Computer-generated peptide variant
LLRWFRRFWKFLPCRTDYKRRVGRLLFLYKKLVREKERAPRLLYKGLILGLQILALCRFSKL

SEQ ID NO: 6854 - protein, 40 aa, Artificial Sequence
  Computer-generated peptide variant
FIKLLRKLMRRYPNWRWAAAQYRLKHWFRWARLHSLKREE

SEQ ID NO: 6855 - protein, 42 aa, Artificial Sequence
  Computer-generated peptide variant
WLKWLTRLLRRLTNLMKLKAKNCKGLYGTKKFHNLRASLELG

SEQ ID NO: 6856 - protein, 20 aa, Artificial Sequence
  Computer-generated peptide variant
LWRYMQRYWKLLRCWRLKLR

SEQ ID NO: 6857 - protein, 80 aa, Artificial Sequence
  Computer-generated peptide variant
WIKFWKRILRIYCKEKADHKMPFKSVRLPAASKANLMRALLTWKQMVKRAAALLLRRARDRNKLAKQTADYKLKRVRVAI

SEQ ID NO: 6858 - protein, 58 aa, Artificial Sequence
  Computer-generated peptide variant
YMRFFQRIFRMLKTKFRLHKTLKARKVMVAHIRRAQARKLACFLAALDEELLLARGII

SEQ ID NO: 6859 - protein, 42 aa, Artificial Sequence
  Computer-generated peptide variant
FFRLLRKFLRRWCRKRDKKLARLVCAAKRQDNAQAAMSWHLN

SEQ ID NO: 6860 - protein, 21 aa, Artificial Sequence
  Computer-generated peptide variant
KLRLLCKLFRIFKNHGLQRAA

SEQ ID NO: 6861 - protein, 84 aa, Artificial Sequence
  Computer-generated peptide variant
ILKWWRRLLKRFKKARLRTKGWVLYLKFAYDPKLKRNRRFKAWWLYSTEKKCATAAAETACKNTMRRGRNGDLVKELQPAARLL

SEQ ID NO: 6862 - protein, 38 aa, Artificial Sequence
  Computer-generated peptide variant
RLRYIRRFFRWIRKRNGRTCLNLALAICHDAKIAKLLM

SEQ ID NO: 6863 - protein, 21 aa, Artificial Sequence
  Computer-generated peptide variant
LLRLMSKYMKKLRRGNYLCLS

SEQ ID NO: 6864 - protein, 78 aa, Artificial Sequence
  Computer-generated peptide variant
WLKLLKRWYRKFRTAATRILELALAGHPQKFARLLKRTAKKIRAHKKLTTRLRSLLKWHATYLYWHAAMCVGEAPFRT

SEQ ID NO: 6865 - protein, 20 aa, Artificial Sequence
  Computer-generated peptide variant
LLKILTKYFKRICRLADAKL

SEQ ID NO: 6866 - protein, 30 aa, Artificial Sequence
  Computer-generated peptide variant
RFKLLCKFYKRWRTPLRFRYALQFSGARKL

SEQ ID NO: 6867 - protein, 53 aa, Artificial Sequence
  Computer-generated peptide variant
RLRMWRKLFRMWRRVAQLAKNRAAAAYKAKLKVAMNYAFRYNSARRWLAMLFW

SEQ ID NO: 6868 - protein, 39 aa, Artificial Sequence
  Computer-generated peptide variant
KFRLLRRLLRMFSCIKRNLELDWAIARKKCNAWKRDLKY

SEQ ID NO: 6869 - protein, 53 aa, Artificial Sequence
  Computer-generated peptide variant
RFRFLPKFLKKLQKQFRALNLTARRKMETAGKKMLLNRYKLAAAKTAALFLAQ

SEQ ID NO: 6870 - protein, 61 aa, Artificial Sequence
  Computer-generated peptide variant
RLKWFCKFLRRFKRRRRRQRHLTPARIVLKAVAAARFKRQKLKLLKPHTAADPAWGVPFGV

SEQ ID NO: 6871 - protein, 37 aa, Artificial Sequence
  Computer-generated peptide variant
LLRLLKKMLKLLRHVTVRKKARLPNIPRDMKMFALLM

SEQ ID NO: 6872 - protein, 32 aa, Artificial Sequence
  Computer-generated peptide variant
FFKLLKRYMRKLRQREEQKLMLLATCLVRKAR

SEQ ID NO: 6873 - protein, 60 aa, Artificial Sequence
  Computer-generated peptide variant
RYKWIHRMLKRYPKNKVLAKAQSRGAFRDLVALAARATRLPKAQLKLKRARWFAFAWMLA

SEQ ID NO: 6874 - protein, 59 aa, Artificial Sequence
  Computer-generated peptide variant
KFRLMKKIWKFYTHAALIVQRILKAKQKRRRQYRAALVLRAKKGLYAKTQALMMDPALG

SEQ ID NO: 6875 - protein, 29 aa, Artificial Sequence
  Computer-generated peptide variant
ILKIMKKLLKYWKRSISHANAKARMLEMA

SEQ ID NO: 6876 - protein, 38 aa, Artificial Sequence
  Computer-generated peptide variant
MIKLYRKLYKLWKPEMKGLFRTKGLHSKWNALARRRLS

SEQ ID NO: 6877 - protein, 42 aa, Artificial Sequence
  Computer-generated peptide variant
KMRWLNKLLRLWRHLTIYILAHWANLLAKCKLKLLKRYGRER

SEQ ID NO: 6878 - protein, 45 aa, Artificial Sequence
  Computer-generated peptide variant
FFKYYRKLFRWFSKGAAGKRRSNALSDRAAKPACKASRYLRLKRS

SEQ ID NO: 6879 - protein, 58 aa, Artificial Sequence
  Computer-generated peptide variant
RLKWLKKFLKMLKHRRLKFLNRLAPMLSNPYKMPACRYTARRMKIQALLCDAKNAENK

SEQ ID NO: 6880 - protein, 27 aa, Artificial Sequence
  Computer-generated peptide variant
YLRYFKKLFRRINKQLLKAAACMQKQV

SEQ ID NO: 6881 - protein, 43 aa, Artificial Sequence
  Computer-generated peptide variant
RLRLLRRLFKKFTCYLLRWGHKFRVSFKCRAAKARNMRLKADF

SEQ ID NO: 6882 - protein, 30 aa, Artificial Sequence
  Computer-generated peptide variant
RFKYYTRLLRWFKKLVKLRGAELLTAHARG

SEQ ID NO: 6883 - protein, 38 aa, Artificial Sequence
  Computer-generated peptide variant
IFRMIRRYLRYLKRPKLLRRKNSLRLLMLLATKCFAQC

SEQ ID NO: 6884 - protein, 58 aa, Artificial Sequence
  Computer-generated peptide variant
MWKLLPKILRRLKHFMKLHKELRKRRKMALLKRTARRIWVGNTHADRMQCSNRHALLK

SEQ ID NO: 6885 - protein, 35 aa, Artificial Sequence
  Computer-generated peptide variant
FLKFIRRWLKLFNPVAARKLKLKRDWKWMQLNKAK

SEQ ID NO: 6886 - protein, 100 aa, Artificial Sequence
  Computer-generated peptide variant
RMKMWKKLLRKLNKLLLYLQFKRHAQAALPLKNRRARFNSLDLFKNRTRSCKVLAKNDKLKLKDHILRRDLLLKDRDTCNMKRFALKYIFLGDNFASRRG

SEQ ID NO: 6887 - protein, 27 aa, Artificial Sequence
  Computer-generated peptide variant
KLKLWRRYLKRMTNAALKANLILFKTK

SEQ ID NO: 6888 - protein, 24 aa, Artificial Sequence
  Computer-generated peptide variant
WMKYLRKLLKLFCSCARIHTRARA

SEQ ID NO: 6889 - protein, 73 aa, Artificial Sequence
  Computer-generated peptide variant
RIKMFRRYLKRYKNGTRAPDWDLRASASLLALKRRKSLGVHKGAAKRCLRKGFPLHSKLAAYKWQRLRLALPN

SEQ ID NO: 6890 - protein, 46 aa, Artificial Sequence
  Computer-generated peptide variant
LFKMLRKLFRKFRKFAMKRPIKLALKLFKGAGIQTLLIVKMKIRLN

SEQ ID NO: 6891 - protein, 47 aa, Artificial Sequence
  Computer-generated peptide variant
MYKLFKRFLKRYKTTTAYLVAYRKRARARANVRAEKQKGNLELVFLA

SEQ ID NO: 6892 - protein, 52 aa, Artificial Sequence
  Computer-generated peptide variant
MFKMLRRFMKMIQQLRALWIKYKHKKHASCLNALWELKALAHALRKKIYDAK

SEQ ID NO: 6893 - protein, 22 aa, Artificial Sequence
  Computer-generated peptide variant
RLKFFRRLFRYLSSGDKLLLAR

SEQ ID NO: 6894 - protein, 38 aa, Artificial Sequence
  Computer-generated peptide variant
KLKLWTKLLRMFRKVRLKAMKLCETKGFMAYMMKLASC

SEQ ID NO: 6895 - protein, 91 aa, Artificial Sequence
  Computer-generated peptide variant
WFKFLTKFMKFLCHIPQALAAKFKAPLRMIKLVEALLARAKAYPTCRAAYRKLVLARDQCCRENTKQIFAKNMLKGLLRAATKGRLLRKAK

SEQ ID NO: 6896 - protein, 51 aa, Artificial Sequence
  Computer-generated peptide variant
RYRLYKKLWRKMHPIRKKHFIALRALSLIHRECNSTLEALGKWKLFRAKLK

SEQ ID NO: 6897 - protein, 53 aa, Artificial Sequence
  Computer-generated peptide variant
KLRFWKKLFKWMKTNQANVARALKGCWALDRKRMRRAWVARLALPWLLAEKRA

SEQ ID NO: 6898 - protein, 71 aa, Artificial Sequence
  Computer-generated peptide variant
ILRWMRRMFRLIKKLKLLKTRDRLMSARFEDQDQKRRVARSLCGRVKRLLLQAWKRLRIILCRMLAKMASF

SEQ ID NO: 6899 - protein, 20 aa, Artificial Sequence
  Computer-generated peptide variant
FLKLIKRFLKKYRPLHARNQ

SEQ ID NO: 6900 - protein, 65 aa, Artificial Sequence
  Computer-generated peptide variant
MFRWFHRWFKKLPKAAKKRLSEADWRAHAMARHHQLLLLIYKQEAKRKAARMTKAMNGFLANLVL

SEQ ID NO: 6901 - protein, 81 aa, Artificial Sequence
  Computer-generated peptide variant
RLKLLPRLLRLYQNKNWHVILLTDAKKQNQRNAACLITGSPKQMRRRFYACWHKILGRLARAKAKKQTNRFLAKLAKEAMK

SEQ ID NO: 6902 - protein, 29 aa, Artificial Sequence
  Computer-generated peptide variant
KLRYFPRWLKKLHQCKCTRKREGSLLLAM

SEQ ID NO: 6903 - protein, 32 aa, Artificial Sequence
  Computer-generated peptide variant
LWRILTRFYRRLRRLRDWRLKLASDSKAEYKN

SEQ ID NO: 6904 - protein, 29 aa, Artificial Sequence
  Computer-generated peptide variant
RLRLFKRYFKKLHCLSTYDLRAWKCREAY

SEQ ID NO: 6905 - protein, 50 aa, Artificial Sequence
  Computer-generated peptide variant
ILRMIKKLWRRIRRRKKHIAASAPLNGGKCCRAAVTKRKVLNMAARALRC

SEQ ID NO: 6906 - protein, 79 aa, Artificial Sequence
  Computer-generated peptide variant
KFRFLKRFFKKLTRAAEIRKYAGAKIATRLALPARDLREQMKDHRVYNAVRFKMAKFWRRLGARKALFCWRKPRVRVLY

SEQ ID NO: 6907 - protein, 46 aa, Artificial Sequence
  Computer-generated peptide variant
FFRLLKKLLKRLKRLRIRLYVPIRAKGRKRAGSLLKQERAGQAITL

SEQ ID NO: 6908 - protein, 26 aa, Artificial Sequence
  Computer-generated peptide variant
KFRWWPKWYRMWRKASLAALKNKPLL

SEQ ID NO: 6909 - protein, 49 aa, Artificial Sequence
  Computer-generated peptide variant
LFRFMRRYFKRLRSARLTRAEKVWLSKMRTIALAAKWAYDLCPAWKKMA

SEQ ID NO: 6910 - protein, 33 aa, Artificial Sequence
  Computer-generated peptide variant
RIKLLRRLLRKIKCNLEGLLWARGRFSKYRHAK

SEQ ID NO: 6911 - protein, 31 aa, Artificial Sequence
  Computer-generated peptide variant
KFKYLRKLYKRLSRRLLTIRATTGLLRARLA

SEQ ID NO: 6912 - protein, 73 aa, Artificial Sequence
  Computer-generated peptide variant
KIKLMRKFIRYIRKKKAVGGPRRLRYKQCFKALLREPFYKCELDRIAKDKLAAARKRYAQMHKASKALEIQAA

SEQ ID NO: 6913 - protein, 30 aa, Artificial Sequence
  Computer-generated peptide variant
LFKWWRRLMKRLKRAHMSGANKACLKTATL

SEQ ID NO: 6914 - protein, 47 aa, Artificial Sequence
  Computer-generated peptide variant
MLRWLRRLMKRYRRSNWLRIDILLWRLKLLPQIPHLERRGARACKDK

SEQ ID NO: 6915 - protein, 40 aa, Artificial Sequence
  Computer-generated peptide variant
KLKYLKRWLRKFKKRKALEALRCLGYLEQMLTAPKRQLGK

SEQ ID NO: 6916 - protein, 20 aa, Artificial Sequence
  Computer-generated peptide variant
FLKFLRRILKRYKRAQLQIV

SEQ ID NO: 6917 - protein, 24 aa, Artificial Sequence
  Computer-generated peptide variant
IMRILQRLLKKWKRLHKAARWRYA

SEQ ID NO: 6918 - protein, 22 aa, Artificial Sequence
  Computer-generated peptide variant
KLRMLRKYMRLFSRKIKDAIAL

SEQ ID NO: 6919 - protein, 65 aa, Artificial Sequence
  Computer-generated peptide variant
RLRWYSRMFKKYRHLLKEYRENKLARKFQTRKLLKNKKWWARCCLAAFKYKALHMGHMKKLNPLQ

SEQ ID NO: 6920 - protein, 30 aa, Artificial Sequence
  Computer-generated peptide variant
RIKYMKRFFRLLRNALALTLAFKEKMHLAK

SEQ ID NO: 6921 - protein, 38 aa, Artificial Sequence
  Computer-generated peptide variant
FMKLWHRLYKRLRQLKWLRTAPYLDCVDNLRLKNDLRR

SEQ ID NO: 6922 - protein, 57 aa, Artificial Sequence
  Computer-generated peptide variant
FIKLMRRWLRRIKHKAKRNLLADPTLTAQKHWRHFQARANLRLRKSGLLAQTKAMRA

SEQ ID NO: 6923 - protein, 58 aa, Artificial Sequence
  Computer-generated peptide variant
RIRLFNKMLRWLKKYLALKLALHKIALNRLRIRRQKGFRFADRIRFDKQNRAQAAKVL

SEQ ID NO: 6924 - protein, 36 aa, Artificial Sequence
  Computer-generated peptide variant
KYKLYHKFLRFLNTYRMKRALHAKNLSKMLGAAKRF

SEQ ID NO: 6925 - protein, 23 aa, Artificial Sequence
  Computer-generated peptide variant
FLRLYKKLLKKLKRVATLRLELR

SEQ ID NO: 6926 - protein, 41 aa, Artificial Sequence
  Computer-generated peptide variant
RFKLFKKLIRRLRKQCKAKAELTKLWLLKFIYANCKAKPEL

SEQ ID NO: 6927 - protein, 30 aa, Artificial Sequence
  Computer-generated peptide variant
KLKYLHRLYRIFRSCLSRIIWRRELRQAAA

SEQ ID NO: 6928 - protein, 46 aa, Artificial Sequence
  Computer-generated peptide variant
KFRFIKKFWKRMRRRALLELSLAATGGQRSAEKKRHLTSKHALMAC

SEQ ID NO: 6929 - protein, 73 aa, Artificial Sequence
  Computer-generated peptide variant
RLKWFKKIFKRIRTALYALKRAHKNAWETKANRASFCVLRKLRGMRAKKSHFWQLNDLGRRKNALPALAHSDL

SEQ ID NO: 6930 - protein, 39 aa, Artificial Sequence
  Computer-generated peptide variant
RMRLFKRLMRKFCKHLLDSPGNAGAIAETRAAKRMANLA

SEQ ID NO: 6931 - protein, 33 aa, Artificial Sequence
  Computer-generated peptide variant
RLKIYRRWWRKLRRKLLKLRAALAEKGKLPYPP

SEQ ID NO: 6932 - protein, 32 aa, Artificial Sequence
  Computer-generated peptide variant
LFRFYRKLFRFYQRKMLLKEKKRAHLGLLLST

SEQ ID NO: 6933 - protein, 24 aa, Artificial Sequence
  Computer-generated peptide variant
KLRLYRRLLRFFQKRLCGYAARAI

SEQ ID NO: 6934 - protein, 21 aa, Artificial Sequence
  Computer-generated peptide variant
RMRLLRRLLRMINNRALMGIK

SEQ ID NO: 6935 - protein, 20 aa, Artificial Sequence
  Computer-generated peptide variant
LLRLLSKYIKMLKKAESFAR

SEQ ID NO: 6936 - protein, 35 aa, Artificial Sequence
  Computer-generated peptide variant
LLKFMQKILRKFRQLRMYGELAAALAKRKHACESH

SEQ ID NO: 6937 - protein, 52 aa, Artificial Sequence
  Computer-generated peptide variant
YMRLLKKWLRRLKREKLERKMSCLIAAKANSAFARAYPWVCLDIARDIKWLM

SEQ ID NO: 6938 - protein, 48 aa, Artificial Sequence
  Computer-generated peptide variant
RYRWFRKFLKLWSNRAHLRDKLRLPKRVALLAVLLYGKLVGPVARQAS

SEQ ID NO: 6939 - protein, 94 aa, Artificial Sequence
  Computer-generated peptide variant
LMKFWKRFFKYMKKRAVYRRKKLGKLRRVAKGDKSQKAARTCLRQLQMYLTKLLMYGPAKHAPRLKCDAKICSTLQKAGFYRRAPKLVAVMKRA

SEQ ID NO: 6940 - protein, 29 aa, Artificial Sequence
  Computer-generated peptide variant
RLKILQRLFRFWNKFRLVCAARSCNARLS

SEQ ID NO: 6941 - protein, 22 aa, Artificial Sequence
  Computer-generated peptide variant
RMRLYQRWMRLMKKALPRLEAK

SEQ ID NO: 6942 - protein, 54 aa, Artificial Sequence
  Computer-generated peptide variant
RLRYLKKFYKWLNTGAIKAKANARRTLAHAHFFGDAKAVGGKRWMRKLLACDLK

SEQ ID NO: 6943 - protein, 44 aa, Artificial Sequence
  Computer-generated peptide variant
FLRFFNKFWKKYRRKELHTKANKLELQLEFATDKAPAALKLAMK

SEQ ID NO: 6944 - protein, 33 aa, Artificial Sequence
  Computer-generated peptide variant
MFRYLRKLLRKIRKLADRLMRRMADQMTKAANR

SEQ ID NO: 6945 - protein, 58 aa, Artificial Sequence
  Computer-generated peptide variant
KLKLLRKYLKFLHPAFSYAFAVKGVTRANRFARITMGSARLVAATIALKQLHHRRARS

SEQ ID NO: 6946 - protein, 46 aa, Artificial Sequence
  Computer-generated peptide variant
KMRIMRRWYKLWKRTAADIKRLALDAKWLLPELARNGPDARAHRLL

SEQ ID NO: 6947 - protein, 28 aa, Artificial Sequence
  Computer-generated peptide variant
RMRLYKRFIRKWKKANLEAMSLKANGFA

SEQ ID NO: 6948 - protein, 44 aa, Artificial Sequence
  Computer-generated peptide variant
KWKLLKKLIKKFPKEATKWTLNLALHPRTLIKAAQKKVIASMRA

SEQ ID NO: 6949 - protein, 70 aa, Artificial Sequence
  Computer-generated peptide variant
KYRFLKRILKRMSRMLLAAWLYNWRACLWDARLGHLACAQMKMQTAARKYFDRKLYSARWLWSIAWKKAL

SEQ ID NO: 6950 - protein, 91 aa, Artificial Sequence
  Computer-generated peptide variant
RIKWWRRWFKRLKRARRRAMPPRYNHARKAALKKAVASLARWLRMHTRTKRRSQLFDALYARARYYFAMYMMNDFILRKADWLAKLAEQKF

SEQ ID NO: 6951 - protein, 32 aa, Artificial Sequence
  Computer-generated peptide variant
RLKFYCKYLKKFRRAHKWGAFLRILLGVKLYR

SEQ ID NO: 6952 - protein, 26 aa, Artificial Sequence
  Computer-generated peptide variant
LLKIFKKLLRRMNKLKAEIWLLAKIG

SEQ ID NO: 6953 - protein, 22 aa, Artificial Sequence
  Computer-generated peptide variant
RYRILRRYLRRFKPALFRLVLD

SEQ ID NO: 6954 - protein, 47 aa, Artificial Sequence
  Computer-generated peptide variant
MWRLYRKWIRKFRKCVGRKTLLRRCAAAALMRMARWRVKLSGDAVWF

SEQ ID NO: 6955 - protein, 48 aa, Artificial Sequence
  Computer-generated peptide variant
RLKILKKFLKIIRSLLQKYAKKFKCEALFLQSVNYPLKKAARPARLSD

SEQ ID NO: 6956 - protein, 100 aa, Artificial Sequence
  Computer-generated peptide variant
IYRLYTKMFKYYHRKNRYWSIIFKVKRALEALALKRKILLLHLVALTNCAYAKRKYTRTAKMLRRCVEKLCRFAALWCKCMFRKWKARVSTAKAAKLKDW

SEQ ID NO: 6957 - protein, 25 aa, Artificial Sequence
  Computer-generated peptide variant
KFRYLRRYLKLFNRAALKFLARKAL

SEQ ID NO: 6958 - protein, 36 aa, Artificial Sequence
  Computer-generated peptide variant
MLRFLTRWFRKLHHKNARLARAKSAFATYNRHDAMA

SEQ ID NO: 6959 - protein, 24 aa, Artificial Sequence
  Computer-generated peptide variant
KYKWYCKLFRKLKKYLALTELRQW

SEQ ID NO: 6960 - protein, 21 aa, Artificial Sequence
  Computer-generated peptide variant
LLKMLHRFLRKMSKLEQAGRY

SEQ ID NO: 6961 - protein, 42 aa, Artificial Sequence
  Computer-generated peptide variant
LLRIWKRMLRRLKRLALCLKKKMRTAKQEAHRKNLANAYSCL

SEQ ID NO: 6962 - protein, 43 aa, Artificial Sequence
  Computer-generated peptide variant
KLRYLRRFYKLLSKKKRRKRYKNAKLLARGYFKAWMMAYVATA

SEQ ID NO: 6963 - protein, 64 aa, Artificial Sequence
  Computer-generated peptide variant
KIKLMKRYLRKIHKKRNCTRLWLAAWKRAGKKPKQALFAALSALKRKEGLNKHAVEMVLRMRAT

SEQ ID NO: 6964 - protein, 51 aa, Artificial Sequence
  Computer-generated peptide variant
KLKWFNRMLRRFKKLQLAKLRANINFGSLCHCCRAPPAKNCKFLAILLKAL

SEQ ID NO: 6965 - protein, 54 aa, Artificial Sequence
  Computer-generated peptide variant
RFKFIKKMMRKLRRRRQRKRDLLSLWQALLVLALGLYCCKVPKELAGRRLRDVR

SEQ ID NO: 6966 - protein, 28 aa, Artificial Sequence
  Computer-generated peptide variant
KFRLMRKFLKKWCHAQKYLDMALAQRCA

SEQ ID NO: 6967 - protein, 52 aa, Artificial Sequence
  Computer-generated peptide variant
RWRWLRKLFRKYCKIKKEAKAGHPARKHADLRLLLPRGTLHKYNVPLVMHKA

SEQ ID NO: 6968 - protein, 23 aa, Artificial Sequence
  Computer-generated peptide variant
LLKFFQKLFRLMCRRDAKRAAAR

SEQ ID NO: 6969 - protein, 24 aa, Artificial Sequence
  Computer-generated peptide variant
RMRLYKRLFKRFKRGAEFPAPLEL

SEQ ID NO: 6970 - protein, 57 aa, Artificial Sequence
  Computer-generated peptide variant
FYRMLRRWYRLLRCKPQDRRAALARHKYNKEMTAFRALRKTLAKYRWAPRLMLLFEI

SEQ ID NO: 6971 - protein, 48 aa, Artificial Sequence
  Computer-generated peptide variant
FLKILKKLMKRLRPCDVPAAAKHRIRNRLKKLSYDASKAWEAKKAWRY

SEQ ID NO: 6972 - protein, 34 aa, Artificial Sequence
  Computer-generated peptide variant
KLRLLQKMYRFLRCRALEWVLSEKKNLERTLVAL

SEQ ID NO: 6973 - protein, 33 aa, Artificial Sequence
  Computer-generated peptide variant
WLRIIRKILRFLKRRDKKLNLCIAQIFRAKHIA

SEQ ID NO: 6974 - protein, 25 aa, Artificial Sequence
  Computer-generated peptide variant
WWRYMQRWLKLLTKAPRKNLQRWLA

SEQ ID NO: 6975 - protein, 22 aa, Artificial Sequence
  Computer-generated peptide variant
LLRLFRKLIKKFKKLKPAELRL

SEQ ID NO: 6976 - protein, 31 aa, Artificial Sequence
  Computer-generated peptide variant
KLRILPKLYKLLRKWLGITLRWSRFLEFRAA

SEQ ID NO: 6977 - protein, 22 aa, Artificial Sequence
  Computer-generated peptide variant
FMKLLRRIFKKLRNLAARHCHE

SEQ ID NO: 6978 - protein, 56 aa, Artificial Sequence
  Computer-generated peptide variant
LLRYLTKLLRLYHRHNGPQWNGGGARMKAGIRLKKQKLKAQAAEVRLKKAARMIRE

SEQ ID NO: 6979 - protein, 30 aa, Artificial Sequence
  Computer-generated peptide variant
FFKWYRRLIRMLRCLKLDCSARRLHVRARV

SEQ ID NO: 6980 - protein, 34 aa, Artificial Sequence
  Computer-generated peptide variant
LMRMYRRLFKRWKKFALHFAYRLRFKRRRLIAAA

SEQ ID NO: 6981 - protein, 30 aa, Artificial Sequence
  Computer-generated peptide variant
RIRMLTKLFKFFKKTLPIPLKALALLKKPQ

SEQ ID NO: 6982 - protein, 48 aa, Artificial Sequence
  Computer-generated peptide variant
WFRLLKRFLKLFKRAGVKHAELGTCRLRQHAELRFSLYCCKCKRGKLA

SEQ ID NO: 6983 - protein, 29 aa, Artificial Sequence
  Computer-generated peptide variant
FMKFFRKIWKKLKNVDAMKKLAAHLKYAC

SEQ ID NO: 6984 - protein, 37 aa, Artificial Sequence
  Computer-generated peptide variant
LLRIMKRYMKFYHKLPAPNMRTLKALWLKLQVSKKKR

SEQ ID NO: 6985 - protein, 80 aa, Artificial Sequence
  Computer-generated peptide variant
KFRLYKKWMRKLKCQKVNHDMKLMIWCKDKLECKKQRCGLLKKLMLAFLAWLAVNARKRRLHDALSLKTKAIKALKEGPI

SEQ ID NO: 6986 - protein, 62 aa, Artificial Sequence
  Computer-generated peptide variant
RLRMLPRFLKYLRKWKKKARVLDRKEGLGPQAGHKFRKITKLIAVALRYKAKRATSIGANST

SEQ ID NO: 6987 - protein, 29 aa, Artificial Sequence
  Computer-generated peptide variant
KFKFFRRLLRILRSWARWVLDQALRAYRM

SEQ ID NO: 6988 - protein, 43 aa, Artificial Sequence
  Computer-generated peptide variant
KFKIMNRYFKKFRKMCKPAALKLRDKRAWTLPRWLRELMQAFL

SEQ ID NO: 6989 - protein, 34 aa, Artificial Sequence
  Computer-generated peptide variant
RFKLFKRLFRLIQNTQAKAKKALILLERIHLKKP

SEQ ID NO: 6990 - protein, 25 aa, Artificial Sequence
  Computer-generated peptide variant
RFRLLSKWLKKLCKALRIQLKEHLA

SEQ ID NO: 6991 - protein, 42 aa, Artificial Sequence
  Computer-generated peptide variant
RLKIYCRWLRMFKRLKLHKWSGRLPLKAPEAKAAKVSGLFIL

SEQ ID NO: 6992 - protein, 44 aa, Artificial Sequence
  Computer-generated peptide variant
LLKLMKKFFKRLKNSKLALRANMEKKKKRLVALELSVKLNTYWP

SEQ ID NO: 6993 - protein, 39 aa, Artificial Sequence
  Computer-generated peptide variant
KLKLYKRWLKFLRSAYLGAILWPIRMKFFATKLMDKKDR

SEQ ID NO: 6994 - protein, 45 aa, Artificial Sequence
  Computer-generated peptide variant
RMKLLCRLLRLFRPAAKKYIALKKVQKHKARHRKCTNRLKTGLWL

SEQ ID NO: 6995 - protein, 79 aa, Artificial Sequence
  Computer-generated peptide variant
LIKYMKRFFKRLHHKKPKDRACVLIARCKDLAIKNLRNKLKRRANLRCIARVLAASAVNLTNDSLLGLKDKMAKLAYDM

SEQ ID NO: 6996 - protein, 95 aa, Artificial Sequence
  Computer-generated peptide variant
MLRLFSKYLRKLRKLQLWLKCCKRALGKMKRATLKRAKKARCWQKRPRLLCGLMHQVTGYKMAANKVRAAQSLVRKGLHLHDVKPLFDLERFKRI

SEQ ID NO: 6997 - protein, 32 aa, Artificial Sequence
  Computer-generated peptide variant
IYKMLKRLFRRFPRAKAKTASLIYKGARFMAK

SEQ ID NO: 6998 - protein, 67 aa, Artificial Sequence
  Computer-generated peptide variant
LLRLYTRLLKLISNEAWALRGQCCLRYRACSARKRRLREKRDAQNFRGDSLEAKRALQLLRRKESTG

SEQ ID NO: 6999 - protein, 93 aa, Artificial Sequence
  Computer-generated peptide variant
IIRFLKRILRRYRSYRRLDKEEVNMDRDLFKKGYAALRDRCKKKRLFPFKHAARRYACKLANNRMLLKKLQQAPALKDLKDFARKLADWSLNN

SEQ ID NO: 7000 - protein, 29 aa, Artificial Sequence
  Computer-generated peptide variant
WMRLISRWLRMFRRRVRGAPARRLPHAFA

SEQ ID NO: 7001 - protein, 45 aa, Artificial Sequence
  Computer-generated peptide variant
RLRLLPKFLRLIRRKAWVALVARLTRCREGKSAKLVVMFWVLRQM

SEQ ID NO: 7002 - protein, 41 aa, Artificial Sequence
  Computer-generated peptide variant
KFKILNKLLKRICKLLNALLLTLKTGLMGFEHKHVAKKRGK

SEQ ID NO: 7003 - protein, 25 aa, Artificial Sequence
  Computer-generated peptide variant
KYRLLQRLFRKFPRLANYLANRFHS

SEQ ID NO: 7004 - protein, 56 aa, Artificial Sequence
  Computer-generated peptide variant
RLRMWPRYMKLFRRRAKIILANKRLYAKARLCNGAARFCLRLCVPERVALLTFLTY

SEQ ID NO: 7005 - protein, 23 aa, Artificial Sequence
  Computer-generated peptide variant
FLRYLRKYLKRFRNKKLAKSLPL

SEQ ID NO: 7006 - protein, 86 aa, Artificial Sequence
  Computer-generated peptide variant
KFRFYRRMLRRLRSRQLCRVFLKLARRAEVNAKNRLLIALQAASPFRKSTAAHVSRKKDARRKDIWEMSLALLAAQLKKGKDRRLK

SEQ ID NO: 7007 - protein, 43 aa, Artificial Sequence
  Computer-generated peptide variant
KLRLLPKWLRKFKSLQKILKMKSRDNGVCAKAHLCLLARARRK

SEQ ID NO: 7008 - protein, 96 aa, Artificial Sequence
  Computer-generated peptide variant
KLKYLKRYLRRFHNAKYCLLDAKYKIDKIQAEPYVDDGKAPARKWLHNAATAHACKLARHTKLRQCEKKSMTKKADANARCAKKAPRKHLKSRLSA

SEQ ID NO: 7009 - protein, 33 aa, Artificial Sequence
  Computer-generated peptide variant
RLKLYKRLFRLFQKKKAGFNGRLLLTAGMKDKE

SEQ ID NO: 7010 - protein, 38 aa, Artificial Sequence
  Computer-generated peptide variant
RLRILRRLLKMLRRRFWAVGAYSRLDLLRLINWIEDFW

SEQ ID NO: 7011 - protein, 32 aa, Artificial Sequence
  Computer-generated peptide variant
RFKFFSKLLKILTKATRMGVAFAKLNFIRARL

SEQ ID NO: 7012 - protein, 82 aa, Artificial Sequence
  Computer-generated peptide variant
RLKYFPKFFKWYRSWALYATLRRHWRTFGALRKMLKRKCSTARMRFTWARIYLKSLQWLGIARKEKLKLKPKRCRKLSDLKL

SEQ ID NO: 7013 - protein, 31 aa, Artificial Sequence
  Computer-generated peptide variant
FYRLFRRLMKYIKRAKLKRMQARWKLLNDLL

SEQ ID NO: 7014 - protein, 80 aa, Artificial Sequence
  Computer-generated peptide variant
LMRLLRRLLRKLRKLPPLNWMCTRKANALRAGGLKNHNLRDRIPYGLKLKSQLVMWVRGYIFAKPCPARAEYRKELRRYL

SEQ ID NO: 7015 - protein, 34 aa, Artificial Sequence
  Computer-generated peptide variant
KIKLYKRLFRMLRKRGAWADYYYTRDTLFLEARR

SEQ ID NO: 7016 - protein, 23 aa, Artificial Sequence
  Computer-generated peptide variant
LMKIYNKYLKRYRKGRAWILKLL

SEQ ID NO: 7017 - protein, 37 aa, Artificial Sequence
  Computer-generated peptide variant
RFKFFKKLLKKLQTLDNEFLRAPMASVQNRLARAREK

SEQ ID NO: 7018 - protein, 54 aa, Artificial Sequence
  Computer-generated peptide variant
RFRFLKKFLRKLTHCTKECKPQWIQCLLGQWTSLKYFKGAATLKAAAALLRRRA

SEQ ID NO: 7019 - protein, 56 aa, Artificial Sequence
  Computer-generated peptide variant
LLRWLCRLFRWLRCRKKAHPVLLKETYKKVIHGAGRREKKLKHKAKFLLLLKNDQA

SEQ ID NO: 7020 - protein, 57 aa, Artificial Sequence
  Computer-generated peptide variant
LIKLYRRIIRRFKSHKVLVAGQRLITCLAKMVTTCADVLALLRALLRKALGSFLRKK

SEQ ID NO: 7021 - protein, 30 aa, Artificial Sequence
  Computer-generated peptide variant
LYKLIKRMLKKWQRLAVLRKARRRDLGYTC

SEQ ID NO: 7022 - protein, 23 aa, Artificial Sequence
  Computer-generated peptide variant
KLKLFPKFLKRLRSALSHKMVDS

SEQ ID NO: 7023 - protein, 64 aa, Artificial Sequence
  Computer-generated peptide variant
FMRFLCKLFKLLRNALKKQCLRMKKQKRKIRLRLCNLITKAGGRIDLLTPLHNAPRRKEAKLLK

SEQ ID NO: 7024 - protein, 52 aa, Artificial Sequence
  Computer-generated peptide variant
RLRMLRKMFKKLKHELRWAPDAKELHPLKKARKRQLLQATAPTSQHAYKRSV

SEQ ID NO: 7025 - protein, 36 aa, Artificial Sequence
  Computer-generated peptide variant
RLRMLPRWWRKLRKLVSIMLTKKALRTCQRAPAGDI

SEQ ID NO: 7026 - protein, 26 aa, Artificial Sequence
  Computer-generated peptide variant
WMKFLRRLMKRLRQMAACGRARQKLL

SEQ ID NO: 7027 - protein, 64 aa, Artificial Sequence
  Computer-generated peptide variant
RLKLYRRLFKRLSKRHQMNDDHRREEKALHLARAKGTRCLACSPQFEKPLFLLARSLKLRTRLY

SEQ ID NO: 7028 - protein, 35 aa, Artificial Sequence
  Computer-generated peptide variant
KFRILKRFMKKWSKGPHLLRARACDEFIRKLALGA

SEQ ID NO: 7029 - protein, 20 aa, Artificial Sequence
  Computer-generated peptide variant
MWRLLPRLYKLMKQAHEKQR

SEQ ID NO: 7030 - protein, 20 aa, Artificial Sequence
  Computer-generated peptide variant
IIKYITKLLRIFRKAYLKLV

SEQ ID NO: 7031 - protein, 32 aa, Artificial Sequence
  Computer-generated peptide variant
KIKLWTKLFKYLQKILLRPLRRYRLKAICLSK

SEQ ID NO: 7032 - protein, 38 aa, Artificial Sequence
  Computer-generated peptide variant
KFRFFKRMFKKLKNRPRRLVKLDSMLSIRLAQILLYYA

SEQ ID NO: 7033 - protein, 25 aa, Artificial Sequence
  Computer-generated peptide variant
RLRWLHRLYRFLRHLLVVVKKSWRA

SEQ ID NO: 7034 - protein, 40 aa, Artificial Sequence
  Computer-generated peptide variant
KLRWLRKFFKRFQRMTKLWELRKHYRLDAGCDKLAQARSA

SEQ ID NO: 7035 - protein, 31 aa, Artificial Sequence
  Computer-generated peptide variant
IFRWWRRLIRKLTNKLARCLLLVRFQRHAAK

SEQ ID NO: 7036 - protein, 36 aa, Artificial Sequence
  Computer-generated peptide variant
KYKYLKRFFKMLTKLYRLKLALLIWMNKKAILKAWR

SEQ ID NO: 7037 - protein, 25 aa, Artificial Sequence
  Computer-generated peptide variant
LFKWWKKMWRRLRKRTKALNLLHVA

SEQ ID NO: 7038 - protein, 20 aa, Artificial Sequence
  Computer-generated peptide variant
KFRLITKLWRRLQKPQEAEL

SEQ ID NO: 7039 - protein, 76 aa, Artificial Sequence
  Computer-generated peptide variant
RLKYFRRLLKRIRKRASKACGRGMKMRERRAKSLLGFYLIRNCAVLLLAGGYRMAHPDQAPASRLHLRDCVTYRAL

SEQ ID NO: 7040 - protein, 52 aa, Artificial Sequence
  Computer-generated peptide variant
RIKYLRRLLRYLRNDLYYIKIKAYKAADLWRLKAYMRARWIPIRLPTALKIL

SEQ ID NO: 7041 - protein, 20 aa, Artificial Sequence
  Computer-generated peptide variant
LLRLFPRMMKRLKTKTAAAN

SEQ ID NO: 7042 - protein, 60 aa, Artificial Sequence
  Computer-generated peptide variant
RWRFLNRIIRFFRNKLLAIKALVALACKYMKQGNKAENKKTRALKDKKMLPKGDPIKWLA

SEQ ID NO: 7043 - protein, 28 aa, Artificial Sequence
  Computer-generated peptide variant
LLKLLRKYFRKMKRMLALASKDKRLTEA

SEQ ID NO: 7044 - protein, 28 aa, Artificial Sequence
  Computer-generated peptide variant
KWRMLRKFLKKLKRLRDLASGFFVPAGT

SEQ ID NO: 7045 - protein, 22 aa, Artificial Sequence
  Computer-generated peptide variant
LMKLLRRLYRKYKRVLALVSAC

SEQ ID NO: 7046 - protein, 29 aa, Artificial Sequence
  Computer-generated peptide variant
RFKMWKKFYRKLCRDAAFAALARVSCYLS

SEQ ID NO: 7047 - protein, 30 aa, Artificial Sequence
  Computer-generated peptide variant
YLKFFKRLLKWMRNGVKWQRLPLLLKLRRA

SEQ ID NO: 7048 - protein, 66 aa, Artificial Sequence
  Computer-generated peptide variant
FLRLLNKLLKWLNHKLKAPGKRKCFHLADLDRMYADCMAFKRNMKWARTAVLKCALARNTGRWLRL

SEQ ID NO: 7049 - protein, 77 aa, Artificial Sequence
  Computer-generated peptide variant
LIKLFRRFFRKLKRFRAKRLRMANESGAGRCAMTANARAVAMYRCLEAVIPKFRGRQCKYACLMKKLKRRNDNKRTA

SEQ ID NO: 7050 - protein, 21 aa, Artificial Sequence
  Computer-generated peptide variant
KLRLMTRWIKRIKRVAAHLNS

SEQ ID NO: 7051 - protein, 38 aa, Artificial Sequence
  Computer-generated peptide variant
LLRLWKRIIKLICKARAFRKDSRLNSECTLAPSILAEK

SEQ ID NO: 7052 - protein, 50 aa, Artificial Sequence
  Computer-generated peptide variant
LYKLLPKLWRKYKRAKRSLRAKKRPFCQRRMLLLVAQMPWELERKPAMYC

SEQ ID NO: 7053 - protein, 27 aa, Artificial Sequence
  Computer-generated peptide variant
KLKWWHKLFRRLRRLGLLLGELRARLM

SEQ ID NO: 7054 - protein, 28 aa, Artificial Sequence
  Computer-generated peptide variant
KWRWLHKLYKMLRRLWVLMAAAKLRMRN

SEQ ID NO: 7055 - protein, 72 aa, Artificial Sequence
  Computer-generated peptide variant
LFKYYRKYFRKFRCLRYKPMTLEEYYTRPQALLGAIKLRKLKLLYIASDAVRLKKNKLCVKLTRKLWLKGGK

SEQ ID NO: 7056 - protein, 59 aa, Artificial Sequence
  Computer-generated peptide variant
IWRLLKKLFKYIRKLKLWERPPCRRRKRLKRDLLLADKKYLTPQRWHMLLLNKLRNTFP

SEQ ID NO: 7057 - protein, 28 aa, Artificial Sequence
  Computer-generated peptide variant
MIRWMHKLLKRLRKLRRTAESWYSLAKQ

SEQ ID NO: 7058 - protein, 25 aa, Artificial Sequence
  Computer-generated peptide variant
WWRFLRRFLRKLKKERNAAAKAMNC

SEQ ID NO: 7059 - protein, 23 aa, Artificial Sequence
  Computer-generated peptide variant
LIRIMKRLFRKMKNKGLDTAAAY

SEQ ID NO: 7060 - protein, 25 aa, Artificial Sequence
  Computer-generated peptide variant
MLRYYRRILKWYQKALRKALLEFCQ

SEQ ID NO: 7061 - protein, 37 aa, Artificial Sequence
  Computer-generated peptide variant
KYRFIKRLLKRLNQRLKQALCTKWRAAIKKTEYVAML

SEQ ID NO: 7062 - protein, 86 aa, Artificial Sequence
  Computer-generated peptide variant
KIRLFPRFWRRIKKQAETKLLGTLVQPLKKEKWAKCERAALRKNKRARAHRPALAVKCPGEKAKTELWYRSRLSHFAKMAYAKMAL

SEQ ID NO: 7063 - protein, 48 aa, Artificial Sequence
  Computer-generated peptide variant
LFKLFRKLFKRMRRGNWKVAKAKSAKLIKARETAQITRYGFDAKLKLH

SEQ ID NO: 7064 - protein, 53 aa, Artificial Sequence
  Computer-generated peptide variant
FFRLLRRWYRLYQRIRKMKRAHGVAYWLRDFRRAQRLLAAAKMKRFKFLNDNL

SEQ ID NO: 7065 - protein, 51 aa, Artificial Sequence
  Computer-generated peptide variant
KWKMYRKLIKWFKCARLKLCKIKMILLTAWRAKAHARLRLKAITKAADRRL

SEQ ID NO: 7066 - protein, 76 aa, Artificial Sequence
  Computer-generated peptide variant
RMKFLNKWLRMLRSGVTRYAARKCHMQRLRQPLKKRCAGRRVLATSLRKAFPLSAAQDLMHFARIFLLWAFNRRRA

SEQ ID NO: 7067 - protein, 27 aa, Artificial Sequence
  Computer-generated peptide variant
FLKILRRLLRRLKQAASKRYAFYCLIW

SEQ ID NO: 7068 - protein, 45 aa, Artificial Sequence
  Computer-generated peptide variant
LFRLIRRLMRKLCKRYAPLYNNKIMRILKIRKEGFALAKATGAYH

SEQ ID NO: 7069 - protein, 31 aa, Artificial Sequence
  Computer-generated peptide variant
WLRMLRRLFRMLKKVKSGLVVCKAKRNSLAR

SEQ ID NO: 7070 - protein, 37 aa, Artificial Sequence
  Computer-generated peptide variant
RIRFWKKLLKKLRCLAALLRMRAQNYRRIKAARDLLG

SEQ ID NO: 7071 - protein, 20 aa, Artificial Sequence
  Computer-generated peptide variant
LLRILKKYYRRWRRNAQATW

SEQ ID NO: 7072 - protein, 24 aa, Artificial Sequence
  Computer-generated peptide variant
MIKLMKKLIKFMNRRRNQLALDRL

SEQ ID NO: 7073 - protein, 27 aa, Artificial Sequence
  Computer-generated peptide variant
KLRWFRRYFKRLKHLVSVASRACLIRA

SEQ ID NO: 7074 - protein, 49 aa, Artificial Sequence
  Computer-generated peptide variant
RLRMLQKLLRKYSTKNEGQLALLWFRLSSLLLKRHAAWRACRWAYRMNN

SEQ ID NO: 7075 - protein, 23 aa, Artificial Sequence
  Computer-generated peptide variant
RYRLIRRLMRKLTKAQATWWLAK

SEQ ID NO: 7076 - protein, 47 aa, Artificial Sequence
  Computer-generated peptide variant
KWRLLHKLLKRLKKADLNMPRAKRRIAVVLMPHLIKTSTKWSARGRA

SEQ ID NO: 7077 - protein, 68 aa, Artificial Sequence
  Computer-generated peptide variant
KIKFFKRLIKWLQKEWHELLKTTYPWKLRKRARLALNFVLFFRRKLPQADYYLCRALSVRKARHIRRK

SEQ ID NO: 7078 - protein, 50 aa, Artificial Sequence
  Computer-generated peptide variant
RFKILSRFLKYYQKTLEYLAALKQKYEPFYLQKKLKKEIEAAKRARPLAF

SEQ ID NO: 7079 - protein, 30 aa, Artificial Sequence
  Computer-generated peptide variant
WWKLLKKLYKFLCKHAIKIDRKKKQMLFAH

SEQ ID NO: 7080 - protein, 29 aa, Artificial Sequence
  Computer-generated peptide variant
RYRMLRKWLKFLRNPALRCNLDHLDARKF

SEQ ID NO: 7081 - protein, 21 aa, Artificial Sequence
  Computer-generated peptide variant
MLKFFKRLFKLLTKHHQKLHK

SEQ ID NO: 7082 - protein, 32 aa, Artificial Sequence
  Computer-generated peptide variant
FWKLLRRFMRRLTRERTHFELKFAAILLRWLR

SEQ ID NO: 7083 - protein, 81 aa, Artificial Sequence
  Computer-generated peptide variant
KMRWLHRILKKIKRANLRSRRFAGNHRENNLQASKKLSPRSDADDRAKAKGAGNKVRTYAHLALKEHPSKAAKHKRLLQRL

SEQ ID NO: 7084 - protein, 30 aa, Artificial Sequence
  Computer-generated peptide variant
RLRLWQRFLKRLKKAWCLSLVKIDLAFGRI

SEQ ID NO: 7085 - protein, 30 aa, Artificial Sequence
  Computer-generated peptide variant
MFKLFHKFIKLFSQAMLLKLWKARAMNKAR

SEQ ID NO: 7086 - protein, 39 aa, Artificial Sequence
  Computer-generated peptide variant
WLKLLKKFFKLWNKQIKAFRAKLARQAKKHPFHFYAMRC

SEQ ID NO: 7087 - protein, 68 aa, Artificial Sequence
  Computer-generated peptide variant
KMKYICRLLKRFKQNLLKLRMYRLKRKVKERLPNEAAVQPVAKWLLKTTKTPTLRKMYLKSAARRFLY

SEQ ID NO: 7088 - protein, 40 aa, Artificial Sequence
  Computer-generated peptide variant
RLKWYQRMLKRLSHGKKALRARGLRWLCDLKFLSLARGIR

SEQ ID NO: 7089 - protein, 32 aa, Artificial Sequence
  Computer-generated peptide variant
RMRLFRKIFRRYNRAVWTWRAQKKLCQAIAAA

SEQ ID NO: 7090 - protein, 21 aa, Artificial Sequence
  Computer-generated peptide variant
RLKILKRYLKLLQNRYSTYKA

SEQ ID NO: 7091 - protein, 62 aa, Artificial Sequence
  Computer-generated peptide variant
YFRFWRRYWRKMNKNKLVKRMKKHRNRRKAEALLHCKTIRCKLIHAWALLYQRHTLKLLNAA

SEQ ID NO: 7092 - protein, 29 aa, Artificial Sequence
  Computer-generated peptide variant
RWKLYSKILRRYCPLLRDERRAAARRACL

SEQ ID NO: 7093 - protein, 68 aa, Artificial Sequence
  Computer-generated peptide variant
LWRIICKLLRKFRHLRLEREKLLLAKYNRRRLALMARDARKHCAHAYEKLLIDPKARRKTTYRKGDKH

SEQ ID NO: 7094 - protein, 25 aa, Artificial Sequence
  Computer-generated peptide variant
LYKLLNKLLRRISKGKLFADLILRK

SEQ ID NO: 7095 - protein, 81 aa, Artificial Sequence
  Computer-generated peptide variant
IYRLIKKFYKKISRKPKAGAARCNKLFAIRMKALIIIRALAFLAAHIANADLLSRKAILELKTIKARKWKRRTLWGMLRSW

SEQ ID NO: 7096 - protein, 23 aa, Artificial Sequence
  Computer-generated peptide variant
KLKMLKRLYRRYTHYLLSLMRCD

SEQ ID NO: 7097 - protein, 80 aa, Artificial Sequence
  Computer-generated peptide variant
RLKFFRRFWRKLKKALLFSPLKLFVADIADMTQFKWKAQKLCVLNRCAAAGLASPKKKIKWKKRRFNRLKEAEPPALMRS

SEQ ID NO: 7098 - protein, 55 aa, Artificial Sequence
  Computer-generated peptide variant
MMRYMKRILKKLRKAAGARPLQRAKAFRWLDLKLKLNDASARYWIRKKAWQKYWN

SEQ ID NO: 7099 - protein, 82 aa, Artificial Sequence
  Computer-generated peptide variant
RLRLLRKLIRRLCKAFWNGRYLLLEEAKQCALSRMWRRQKLKPYCGRQLLQRKKRKAWCAEETARHAQYRAKECIKRRARHN

SEQ ID NO: 7100 - protein, 34 aa, Artificial Sequence
  Computer-generated peptide variant
FLKWWPKYYRKYRRNQQGSKNLKANPLLLLRAAA

SEQ ID NO: 7101 - protein, 32 aa, Artificial Sequence
  Computer-generated peptide variant
LFRLLTRLWKKLTKQSWTMKHLFRAKLQLEKC

SEQ ID NO: 7102 - protein, 40 aa, Artificial Sequence
  Computer-generated peptide variant
LLKYYNRLLRLIRPAFKRKMIEKARKAWKRCRAQKSRLLI

SEQ ID NO: 7103 - protein, 56 aa, Artificial Sequence
  Computer-generated peptide variant
LMKWWKRLFKKIRNIKAETAQLRFPYTWRKCQAMLKYRRSREALILKKALLFLFMR

SEQ ID NO: 7104 - protein, 21 aa, Artificial Sequence
  Computer-generated peptide variant
RLRMLPKIMRFFRREAAKVAI

SEQ ID NO: 7105 - protein, 43 aa, Artificial Sequence
  Computer-generated peptide variant
KLRLIKRLIKRMKTHMNAWAHRHRAAAKTYLLRQREITFKAPF

SEQ ID NO: 7106 - protein, 28 aa, Artificial Sequence
  Computer-generated peptide variant
FLKLIKKFLRMFNRAAYLFLHRKLKRLR

SEQ ID NO: 7107 - protein, 80 aa, Artificial Sequence
  Computer-generated peptide variant
KLKILHRFFRRMKSNLQRLALPRANLKMAPNALYPGAMRHRRMRRKIKHLCASAAENAAKAMNRKVKRQVHSVAGYELKR

SEQ ID NO: 7108 - protein, 41 aa, Artificial Sequence
  Computer-generated peptide variant
KIRLLTKWWKFWRRAYAAQKHLRLRLASSRSLLWNRPWLAT

SEQ ID NO: 7109 - protein, 35 aa, Artificial Sequence
  Computer-generated peptide variant
RYKLYRKLFRRFNKRAMKRHAKQLWEHKGASAAAA

SEQ ID NO: 7110 - protein, 86 aa, Artificial Sequence
  Computer-generated peptide variant
MLRFYRRLLKFFKKLRNGRRWMGKLKDWEKCECKLDLRRARTKHAAKKAAAGMRGRRILNQEKAKPLRKTRPNNHCLFSANLKLLR

SEQ ID NO: 7111 - protein, 25 aa, Artificial Sequence
  Computer-generated peptide variant
FFRLLRRLLRILRRTLEAHRGFELH

SEQ ID NO: 7112 - protein, 65 aa, Artificial Sequence
  Computer-generated peptide variant
MYKFYTKFFKMYRRKHAVDALGRSNLLNNQILRRAEDARLRYPKAARKYRALNKAMWKLALRLDR

SEQ ID NO: 7113 - protein, 37 aa, Artificial Sequence
  Computer-generated peptide variant
WFKLLRKLLKKIQKQPFSLARCLCLPRLHCERQAKLC

SEQ ID NO: 7114 - protein, 50 aa, Artificial Sequence
  Computer-generated peptide variant
MLRFMRKYIRFFRNAKVKKPAALRKPNNNAKLLILKSVAIALYSVLRGKR

SEQ ID NO: 7115 - protein, 94 aa, Artificial Sequence
  Computer-generated peptide variant
FIKLLRKLLKIYKRPTDLMKRRRTALAKWRRNRDKCALKADLIPAASCCLRMWSRIKIMRLMAVKRGYKLKEYLMATDRLEAKARRHELRIAGY

SEQ ID NO: 7116 - protein, 34 aa, Artificial Sequence
  Computer-generated peptide variant
KWKLLQRILRFMKRPKFAAFAKKGNQSARKMNLF

SEQ ID NO: 7117 - protein, 76 aa, Artificial Sequence
  Computer-generated peptide variant
KLRYYCRMLRKLSTARMACTKQKPLLTKRGLHHLGGLRDMSRHMLKGRHQDRAAKVNKAKLWVLLLRDAKLGRRHY

SEQ ID NO: 7118 - protein, 26 aa, Artificial Sequence
  Computer-generated peptide variant
LIKLWQRLLRKLRTKEPVVRLPRNRA

SEQ ID NO: 7119 - protein, 34 aa, Artificial Sequence
  Computer-generated peptide variant
KLRFFHRLLKKFPQLDLKIKAHKLRKAISRPRAS

SEQ ID NO: 7120 - protein, 21 aa, Artificial Sequence
  Computer-generated peptide variant
YLRMWRKLLKRLNRTAKMHML

SEQ ID NO: 7121 - protein, 75 aa, Artificial Sequence
  Computer-generated peptide variant
KWKYYPKIYKFLRQKKVPAHARADLALQMATAFEAKFCRRKALARILCYKIEHYHKKLRMKMLRKKKAKRLLHEM

SEQ ID NO: 7122 - protein, 56 aa, Artificial Sequence
  Computer-generated peptide variant
KLRMLKKFLRLLRTDKAQHRALRCRMSQKQLKATWRLAVLKNLAQALKKYPEPSSN

SEQ ID NO: 7123 - protein, 29 aa, Artificial Sequence
  Computer-generated peptide variant
RYKILCRLYRKIQHALTKKVAALRQSKFE

SEQ ID NO: 7124 - protein, 33 aa, Artificial Sequence
  Computer-generated peptide variant
MFRLMKRYLKLLRRAYYNLVKVKLKKIDHLYIL

SEQ ID NO: 7125 - protein, 75 aa, Artificial Sequence
  Computer-generated peptide variant
LLRLFQKFFRRLNKAWASTRRAKLAKWELRFRRQFGPRASLLRHTIHPLARKLLILDFRAPRLATPKPRKICRNK

SEQ ID NO: 7126 - protein, 53 aa, Artificial Sequence
  Computer-generated peptide variant
RLKYLKKLFRKFRKELMAYSLLKAWGKVACLTASCQASQKRAQPAKHAAQRGF

SEQ ID NO: 7127 - protein, 55 aa, Artificial Sequence
  Computer-generated peptide variant
LYRLFCRIMRKIKRRFKLYAMLRHIAAAKILVKANARRKAHGGAWDSRAALWAII

SEQ ID NO: 7128 - protein, 30 aa, Artificial Sequence
  Computer-generated peptide variant
RMRFLRRFLRKFKQATVAKYARLRLRCWAC

SEQ ID NO: 7129 - protein, 61 aa, Artificial Sequence
  Computer-generated peptide variant
KLRLMHKLFKRMSCAALDAYLKRDRKLFAKQAYSLFTCHVLNKLLANKRKVSALWDLRPPF

SEQ ID NO: 7130 - protein, 40 aa, Artificial Sequence
  Computer-generated peptide variant
LIRLLRRIFKILKCAKEPKLAAEAKCKHARLAAQKRKLCT

SEQ ID NO: 7131 - protein, 29 aa, Artificial Sequence
  Computer-generated peptide variant
KLRLLNKLMRFLQRVQLQMQEKAHLRKLL

SEQ ID NO: 7132 - protein, 48 aa, Artificial Sequence
  Computer-generated peptide variant
FIKMLKRFIKRFKRNADAPQSRKIAAALLLARTAHLLIVFNKLWAFKK

SEQ ID NO: 7133 - protein, 26 aa, Artificial Sequence
  Computer-generated peptide variant
LFRLWKKMIKKLKTAAKPLGKNARRA

SEQ ID NO: 7134 - protein, 24 aa, Artificial Sequence
  Computer-generated peptide variant
KMRLLSKFLKLLKKSTTEGIYKRA

SEQ ID NO: 7135 - protein, 34 aa, Artificial Sequence
  Computer-generated peptide variant
KIRLWRRFFRMLSPLLRAFKFADAMRLRWRALKK

SEQ ID NO: 7136 - protein, 32 aa, Artificial Sequence
  Computer-generated peptide variant
KLKYLPRLFRKFKHQWARDRLICLLPWRVARN

SEQ ID NO: 7137 - protein, 33 aa, Artificial Sequence
  Computer-generated peptide variant
LLRMLNRILRRLTQYLKEGAGKRLPRKRLVKCK

SEQ ID NO: 7138 - protein, 22 aa, Artificial Sequence
  Computer-generated peptide variant
LLRYYRKLFRMMCKAAALRLES

SEQ ID NO: 7139 - protein, 40 aa, Artificial Sequence
  Computer-generated peptide variant
RFKLLKRFWKFMPRHLLHTWANAVKKNTKKMAKLARTRAQ

SEQ ID NO: 7140 - protein, 38 aa, Artificial Sequence
  Computer-generated peptide variant
LYKWIPKFWKKFRNVAHRVRLKALLASHKAPAKRDVWK

SEQ ID NO: 7141 - protein, 100 aa, Artificial Sequence
  Computer-generated peptide variant
RMKLIRKWYKKLSCKHRRRAKSEVYKAMARYLIKKGERSKRLLGSALKLDLLTRHGGPAPKLVDWKLLAGKSAKQCPNAFDLRIYEGRKKMLKLMKNRYR

SEQ ID NO: 7142 - protein, 27 aa, Artificial Sequence
  Computer-generated peptide variant
FIKWLKKLMRLMRPARSLKEKCLHAKL

SEQ ID NO: 7143 - protein, 36 aa, Artificial Sequence
  Computer-generated peptide variant
LYRLYRRMFRKWTKRKAHKKNLTLICKYALCLALPN

SEQ ID NO: 7144 - protein, 31 aa, Artificial Sequence
  Computer-generated peptide variant
RLRWLPKFIKYLRKMCLQCAPKMQKTALALR

SEQ ID NO: 7145 - protein, 32 aa, Artificial Sequence
  Computer-generated peptide variant
KLRFFRRFLKLYKKFMYYKLSAMDAKLMELKQ

SEQ ID NO: 7146 - protein, 36 aa, Artificial Sequence
  Computer-generated peptide variant
LMRYLRRLLRRLKKAAQRLGKMAALKDANCFKLMIE

SEQ ID NO: 7147 - protein, 21 aa, Artificial Sequence
  Computer-generated peptide variant
KLRLLPRWMKRYRPYWLKTAN

SEQ ID NO: 7148 - protein, 75 aa, Artificial Sequence
  Computer-generated peptide variant
KWRWLRKFYRRFRTGKWLLDADQALAARVCLMFRKMRLFFLRKSARDRALAWCRLVRAKARSPVRLWLRWKQLKQ

SEQ ID NO: 7149 - protein, 60 aa, Artificial Sequence
  Computer-generated peptide variant
RLKYYKRLLRLFKNMLEKNYALADRRFFLLAKTALSLACPANRFKLTKLLLKSVPQIVVG

SEQ ID NO: 7150 - protein, 42 aa, Artificial Sequence
  Computer-generated peptide variant
LFKFLKRFIRLMKRLDCLWRKRCRKILIIVAARFLAVKGKVE

SEQ ID NO: 7151 - protein, 69 aa, Artificial Sequence
  Computer-generated peptide variant
KWKLWKRILKIMRKRKTAAAPAVRRLAMRHVRLELELIYNENSKRRNTSARKEAIQRLRCLMRPMIELR

SEQ ID NO: 7152 - protein, 99 aa, Artificial Sequence
  Computer-generated peptide variant
KWKIFKRLLKKLTHLPALHKKNKCNKYLYAYRKPLLKILLLNALIKSRVFRRHLAIPRCMLALPPLALKQLHQGHWEIKYLAKGPRDAWLALLLARKME

SEQ ID NO: 7153 - protein, 63 aa, Artificial Sequence
  Computer-generated peptide variant
KMKLITKMLRRLQKWKGKFKVWPCANQLAALHLQLLKKRTTTRRDRSHRACIRGRAAALAVKY

SEQ ID NO: 7154 - protein, 34 aa, Artificial Sequence
  Computer-generated peptide variant
RLRLIKRMFRKWQTLKLKMLGHCLKPVDALLLKG

SEQ ID NO: 7155 - protein, 23 aa, Artificial Sequence
  Computer-generated peptide variant
RFKLLCRFLKKLRHENELAKLRF

SEQ ID NO: 7156 - protein, 43 aa, Artificial Sequence
  Computer-generated peptide variant
KIKWWTKYLKILRPLLALKRLEKYVLKKKVEAMLSDATKWAQR

SEQ ID NO: 7157 - protein, 64 aa, Artificial Sequence
  Computer-generated peptide variant
KFRFWKRMYKILHHLLKAEKRELRKRYLKALAALAKKRAMKYVAMTKTALRARDSRARAAQPCN

SEQ ID NO: 7158 - protein, 20 aa, Artificial Sequence
  Computer-generated peptide variant
LFKLMKRLFKRLSSARAPKF

SEQ ID NO: 7159 - protein, 29 aa, Artificial Sequence
  Computer-generated peptide variant
LMKYLRKWLKYYRCRAEAYQLARRLFLAH

SEQ ID NO: 7160 - protein, 40 aa, Artificial Sequence
  Computer-generated peptide variant
RMRWLCKFMKIMRPRRALLGKAAIYYQLCRQAKAPKPSKR

SEQ ID NO: 7161 - protein, 29 aa, Artificial Sequence
  Computer-generated peptide variant
LLKFFKKLLRWLKCEKKSVIRVLTARTAL

SEQ ID NO: 7162 - protein, 63 aa, Artificial Sequence
  Computer-generated peptide variant
RWRLLRKFMRFLKKARKAITSNNKYGHKWAWICLFQMRFYKYAAAAQKPRRTLLKKCLAKGRA

SEQ ID NO: 7163 - protein, 73 aa, Artificial Sequence
  Computer-generated peptide variant
RFRFLSRYLRWYKRRASAMKAIFDKARLHQKHTALRIAAAGWRRLMRTGRLKLGAVSLNPAKLLDTLKQDRPG

SEQ ID NO: 7164 - protein, 46 aa, Artificial Sequence
  Computer-generated peptide variant
KLRFLQKWLRKLRRKISVSIRAEMKAVTLAGAVARRFDAHKARYSW

SEQ ID NO: 7165 - protein, 68 aa, Artificial Sequence
  Computer-generated peptide variant
MLRYLSKLLKYYHRKAHKHSKANLNMNALYAAFRALRRYELALRCYAKRACYPCCMIAKWKKLSRWNK

SEQ ID NO: 7166 - protein, 38 aa, Artificial Sequence
  Computer-generated peptide variant
LWRMWQRFIRKITKASLILHCLRNPKKDWAKLRLWAKR

SEQ ID NO: 7167 - protein, 36 aa, Artificial Sequence
  Computer-generated peptide variant
LFRIMPRMFRKFRTAHKAKRSHYKLSLRALMLAKCL

SEQ ID NO: 7168 - protein, 45 aa, Artificial Sequence
  Computer-generated peptide variant
KIKLIRKFLRKIRKCRWAAAVGANKAWLNAAVHAVKALTLRNLKR

SEQ ID NO: 7169 - protein, 94 aa, Artificial Sequence
  Computer-generated peptide variant
RIKLLHRMFKIITKQRRRAMRVIAWQRLAAKCKTAHGWAFLFRRARGAESRRLADLKAGIRLHARRRVKWAAYIKIVWRKLYYAAEKKFLKKKR

SEQ ID NO: 7170 - protein, 84 aa, Artificial Sequence
  Computer-generated peptide variant
RMKFIRKILKFLCKQRKLAVNVWAKWALAKGLSFLRAKCKPEARAMMAALKGAMKFARNLKLLSFWGVKLSAARCPPSRDPRLR

SEQ ID NO: 7171 - protein, 34 aa, Artificial Sequence
  Computer-generated peptide variant
MLRYWHRLFRKLKRDHKKIWKADALYPNKNTAKA

SEQ ID NO: 7172 - protein, 65 aa, Artificial Sequence
  Computer-generated peptide variant
FFRFICKLLKRLKRYLILWKKRKKALAKRLSRDHLARRKWAFKRVYFLWGTLLPAELSWYPTKLN

SEQ ID NO: 7173 - protein, 30 aa, Artificial Sequence
  Computer-generated peptide variant
KWRFLPRMLRRLKRCGAEDMIRALRAHLVP

SEQ ID NO: 7174 - protein, 27 aa, Artificial Sequence
  Computer-generated peptide variant
MWRLLHRFFKLFKREKVRQAAILFRLP

SEQ ID NO: 7175 - protein, 39 aa, Artificial Sequence
  Computer-generated peptide variant
YLRLYKRWLRLYSRRLRNLLLEHYAADGKRMALNLRKWM

SEQ ID NO: 7176 - protein, 22 aa, Artificial Sequence
  Computer-generated peptide variant
KLKLFKRLLRRLTRKLAPKEIA

SEQ ID NO: 7177 - protein, 58 aa, Artificial Sequence
  Computer-generated peptide variant
RWRLFKRFFKRLKRSLLCKRLRGYLLVKSGADALLHARAWRRCLWAIIKQHNPNLLKR

SEQ ID NO: 7178 - protein, 21 aa, Artificial Sequence
  Computer-generated peptide variant
RYKWLNKLWRKFKKKCLLLMA

SEQ ID NO: 7179 - protein, 22 aa, Artificial Sequence
  Computer-generated peptide variant
KLKLFKRFLRMLCQLKGRWRLY

SEQ ID NO: 7180 - protein, 65 aa, Artificial Sequence
  Computer-generated peptide variant
KFKFIKRMWRKITCRMAMERAALYLFKHALCNFKLRIKRHSKDHRGLALWRALAFAALLADHVAL

SEQ ID NO: 7181 - protein, 81 aa, Artificial Sequence
  Computer-generated peptide variant
FFKMFKRWLKKMTHMKAKFILDLEMKKAPSAWNLNYAFELRRLLNKLKLNRRLKRRKVIRAPTLLSPRRKAAQQKQICSRK

SEQ ID NO: 7182 - protein, 80 aa, Artificial Sequence
  Computer-generated peptide variant
KIKMLRRMWRKMKRCLDCLPRKRNSRLQLVAFRRALHRACRTRVKLQALARCAAYTMFKKKMLLAQYMFIAATCFKANDG

SEQ ID NO: 7183 - protein, 40 aa, Artificial Sequence
  Computer-generated peptide variant
KLRMLRKLIKMLKSKRSILIKIKCDLYVIKRRGLLLSLLT

SEQ ID NO: 7184 - protein, 35 aa, Artificial Sequence
  Computer-generated peptide variant
WLRYFRKMIRRLCRPLAKLLSCCLLAEGKWKKFKS

SEQ ID NO: 7185 - protein, 45 aa, Artificial Sequence
  Computer-generated peptide variant
LYRFFQRFYKRFCKLLRKQLRHAPGRYRWLAQNTKLEYARKILLR

SEQ ID NO: 7186 - protein, 38 aa, Artificial Sequence
  Computer-generated peptide variant
RFRMLRKFWRWLKKAFKQTLRPAAALLVATWLDAPMHY

SEQ ID NO: 7187 - protein, 52 aa, Artificial Sequence
  Computer-generated peptide variant
IIRLFSKLYRRLKKMALRRKLLWSNVFHKFKAKYAKRCWRYNLCRFFHLIRL

SEQ ID NO: 7188 - protein, 22 aa, Artificial Sequence
  Computer-generated peptide variant
LMRYLRRIWRLLHKEARVDQAL

SEQ ID NO: 7189 - protein, 63 aa, Artificial Sequence
  Computer-generated peptide variant
KMRLLSRFWKLLHKRDAEVRDAILLLQVWRSRQAKNYEEAALGKAEIARRKRAKKAGRYCLSY

SEQ ID NO: 7190 - protein, 77 aa, Artificial Sequence
  Computer-generated peptide variant
MFRMWNRLLRMLKCRKEALGFRALFARRRRELLALRALIIAWKYKEQAFRCRDRGGRDCFCKLIKKRALIWHIRVPA

SEQ ID NO: 7191 - protein, 45 aa, Artificial Sequence
  Computer-generated peptide variant
WLRIIKKWLRLFRPFTCTRYHARLVAKFRAALLKCCLCWLARYRK

SEQ ID NO: 7192 - protein, 80 aa, Artificial Sequence
  Computer-generated peptide variant
RLRLLRRMLKRIHNGRSNMLVRYMWAWFARCMAIKASAQIRCRLLYCADKLAKLRLKRALLKPKMKHIRRAIKFCRFAPT

SEQ ID NO: 7193 - protein, 44 aa, Artificial Sequence
  Computer-generated peptide variant
LWRYIKKFFKYLKQAAKATRGVLRKAQRALLCGFRRKKLPMPAN

SEQ ID NO: 7194 - protein, 29 aa, Artificial Sequence
  Computer-generated peptide variant
RLRWLKKILKMFNRKLAQHNNVYRIKGLA

SEQ ID NO: 7195 - protein, 80 aa, Artificial Sequence
  Computer-generated peptide variant
KYRFLRRILKRLSRWRRKRYAEEARLLLYSHKNICKNACKARKRWCRVAMFHTHLEVKAWKELIKLDNAGRLAFLARLPY

SEQ ID NO: 7196 - protein, 20 aa, Artificial Sequence
  Computer-generated peptide variant
RFRILRKFFKRMTHPLALNA

SEQ ID NO: 7197 - protein, 47 aa, Artificial Sequence
  Computer-generated peptide variant
LLRYFRRYFRRIRQRANKALQGCELQRTAKKKKCATRLDRAEVIGDL

SEQ ID NO: 7198 - protein, 38 aa, Artificial Sequence
  Computer-generated peptide variant
IYKFLKKLFKKINRIRARFAALLVRRRWPVNYPRGLAC

SEQ ID NO: 7199 - protein, 38 aa, Artificial Sequence
  Computer-generated peptide variant
KWRYLNRYLKFFRRMSKARLRLLSEHLKPRKDNIASLI

SEQ ID NO: 7200 - protein, 55 aa, Artificial Sequence
  Computer-generated peptide variant
MFKLLSRFLKILRRKKLQKYRLRYLRARNGHKLRLRLYAGQNQAVHMAQRMQTLN

SEQ ID NO: 7201 - protein, 97 aa, Artificial Sequence
  Computer-generated peptide variant
RIKMFRRFWKRLQCVRQQRAKWRHKRAKALAALRLPMDLKVLRRPMSRMQAADATQGLCLNLVKYLQSCRRRQKLAKNGCRAMTFKALKNFLWKRKA

SEQ ID NO: 7202 - protein, 47 aa, Artificial Sequence
  Computer-generated peptide variant
KIRFFQRLMKLITRSERDKEAKSWRLPRYLKACKRRAAHLQANARGA

SEQ ID NO: 7203 - protein, 72 aa, Artificial Sequence
  Computer-generated peptide variant
RWRFFCKLLRKLTKRKIRTMCFAWKRLAKKGKKFALATLKNPLQELSRTRRTRHCSRADLASIGERRNLAHK

SEQ ID NO: 7204 - protein, 59 aa, Artificial Sequence
  Computer-generated peptide variant
KLKYLHRLWKMLKSVDERHLMARAWRAKLKDQRLKKRHYMKTQAPLYRHLLLLRSQHPK

SEQ ID NO: 7205 - protein, 70 aa, Artificial Sequence
  Computer-generated peptide variant
IFKILRKFLKFWCRKKKPLKLVWFWVKAARKLEVQAHHAPKANNARAHVHLNLRWQAKRVYKHKKKKSAL

SEQ ID NO: 7206 - protein, 25 aa, Artificial Sequence
  Computer-generated peptide variant
LYKLMTRIIRLISRKDFALGARLLD

SEQ ID NO: 7207 - protein, 25 aa, Artificial Sequence
  Computer-generated peptide variant
LFKLLRKMYRKFRCEPRILLLAGRN

SEQ ID NO: 7208 - protein, 46 aa, Artificial Sequence
  Computer-generated peptide variant
KLKLLRRLYKRYHRGDRKQAMKAYNSLTNATRALLAWLRIACIKRA

SEQ ID NO: 7209 - protein, 49 aa, Artificial Sequence
  Computer-generated peptide variant
KYKLISKLFRRMRKKMAAKLYTLLNGWHTQLRSQSALKALRIPKTRLSG

SEQ ID NO: 7210 - protein, 22 aa, Artificial Sequence
  Computer-generated peptide variant
RLKLLPKYYRILPKVWNKPALR

SEQ ID NO: 7211 - protein, 31 aa, Artificial Sequence
  Computer-generated peptide variant
FIRFLSKYLRLMCRALCAVRAKRNQERMKAA

SEQ ID NO: 7212 - protein, 76 aa, Artificial Sequence
  Computer-generated peptide variant
WIKLLKKLLKYWRKYVALGKSWCANLHAARCLRKMCDHFRRYLAKKKLAHSDLQCATCHLFALDNLKEKSKACALK

SEQ ID NO: 7213 - protein, 41 aa, Artificial Sequence
  Computer-generated peptide variant
RLKLITRILKKLKRRAAATFRLFRAQKKRLMQWRANLEVDD

SEQ ID NO: 7214 - protein, 49 aa, Artificial Sequence
  Computer-generated peptide variant
KLRLLHKFFKILCQRRLHFFRILLLTKMLLKMAIPLTAAMARKKELKKN

SEQ ID NO: 7215 - protein, 25 aa, Artificial Sequence
  Computer-generated peptide variant
RLKLLNKYLKKLKTEQARRRVALEK

SEQ ID NO: 7216 - protein, 48 aa, Artificial Sequence
  Computer-generated peptide variant
FIKLFQKWLKKFRSKLMAYMLWTMIVRLARRLLLNPAKAFKSKTRDKR

SEQ ID NO: 7217 - protein, 64 aa, Artificial Sequence
  Computer-generated peptide variant
KFRLFRKIFRFLQHLEERAMRKGRLKLLQKLLAGRKYAPQQKKWGCKHIRRVAILRRGDALAQR

SEQ ID NO: 7218 - protein, 43 aa, Artificial Sequence
  Computer-generated peptide variant
YIKLFKRFMRRMRCLRARKALWSKIILLDRAEAKKALKAKVDS

SEQ ID NO: 7219 - protein, 23 aa, Artificial Sequence
  Computer-generated peptide variant
YYRYFKKMLRYLRSARNKMFLAA

SEQ ID NO: 7220 - protein, 44 aa, Artificial Sequence
  Computer-generated peptide variant
ILRILTKWMRKLTSFAYLPKLRKHAIAPRRATREPTLWRALMRA

SEQ ID NO: 7221 - protein, 47 aa, Artificial Sequence
  Computer-generated peptide variant
KIRFMSRLLKRWNPNWYRLWFEARLRMMAAYRMCAARVLHKLRKDKL

SEQ ID NO: 7222 - protein, 38 aa, Artificial Sequence
  Computer-generated peptide variant
KFKMLKRLLKWMRHFKAKYLKCFCLGAAECAFRLRVER

SEQ ID NO: 7223 - protein, 74 aa, Artificial Sequence
  Computer-generated peptide variant
FLRFMPKMLKKYNRLRLQICRGRNIDLCKGSDKSRLNCYCKHSYKLRALQAKCKNAGLAARTLLKKLRTAERLK

SEQ ID NO: 7224 - protein, 76 aa, Artificial Sequence
  Computer-generated peptide variant
YWKLIKKFLRKITKRLKLTNKRALLAKRKKFWERHTTRWLHLQKRRRVLKGAYFKWQATAAQWCNQKEAAISGARL

SEQ ID NO: 7225 - protein, 28 aa, Artificial Sequence
  Computer-generated peptide variant
WLRLIRKLLKFLTKKLYLKLMRCTRLRY

SEQ ID NO: 7226 - protein, 56 aa, Artificial Sequence
  Computer-generated peptide variant
RYRMLRKIFKKLRHRFAQKLHLLALVKPAEARHTREADWRLKQTHRRTRAHKLADI

SEQ ID NO: 7227 - protein, 29 aa, Artificial Sequence
  Computer-generated peptide variant
RIKLLKRLMKLFKCKLKQLKLKGCRAILM

SEQ ID NO: 7228 - protein, 22 aa, Artificial Sequence
  Computer-generated peptide variant
KWKLFHRLYRKWRKELAFAMKL

SEQ ID NO: 7229 - protein, 30 aa, Artificial Sequence
  Computer-generated peptide variant
KMRFLRRLLRWWNRCVSVVQANLNALAARK

SEQ ID NO: 7230 - protein, 41 aa, Artificial Sequence
  Computer-generated peptide variant
RFRYWTKIMKRYRKARIAMKLRLLYKLRQLAAQLALHIALP

SEQ ID NO: 7231 - protein, 64 aa, Artificial Sequence
  Computer-generated peptide variant
RIRLIRKWFRKWSKDKRSTATPAKRSPVARVLAQKLYKLRSSKRLARHLLGALLRYGKFFRQNL

SEQ ID NO: 7232 - protein, 22 aa, Artificial Sequence
  Computer-generated peptide variant
RLKMFKRLMRKIQNLALKALRR

SEQ ID NO: 7233 - protein, 20 aa, Artificial Sequence
  Computer-generated peptide variant
FWRYLRKILKKFSQKTLAGA

SEQ ID NO: 7234 - protein, 41 aa, Artificial Sequence
  Computer-generated peptide variant
LYRILRRFFKRWCQGKDLNKDRVARLNKGGLLSATAALMLR

SEQ ID NO: 7235 - protein, 69 aa, Artificial Sequence
  Computer-generated peptide variant
LYKMIRRMLKKLCKLMRCVGCKRAKRRQSAYDFALGYKKRARIRNIRWLLFLLAWGLQRRLSKQVALGK

SEQ ID NO: 7236 - protein, 41 aa, Artificial Sequence
  Computer-generated peptide variant
YLKMLRKFLKRLPKLSKLRNAMVAELRHQPTAPRGLELRTL

SEQ ID NO: 7237 - protein, 63 aa, Artificial Sequence
  Computer-generated peptide variant
RLKLLPRLFKWLKRLQMFYIKKEHKCYLAYNLAVKQMCKQAALVGFKVLKRLAKKMMLLDFGR

SEQ ID NO: 7238 - protein, 49 aa, Artificial Sequence
  Computer-generated peptide variant
RFKLMRRILRRLRCRRHKAKGLWFSLAFNAVVDDAFPRAAAALRLKRCW

SEQ ID NO: 7239 - protein, 50 aa, Artificial Sequence
  Computer-generated peptide variant
LYKLLCRLWRRIRKKAPMAVLSSIQLHYKKAKRMDSKRDLAFGLANLRYA

SEQ ID NO: 7240 - protein, 42 aa, Artificial Sequence
  Computer-generated peptide variant
RLKWFRRLLKILKRRYAVKLAALKNLAKLISVCRKYRDAALN

SEQ ID NO: 7241 - protein, 42 aa, Artificial Sequence
  Computer-generated peptide variant
KLKLLKRFLKRWCRIKYEIWARKDTLRDSTPRLKALVCLKSL

SEQ ID NO: 7242 - protein, 42 aa, Artificial Sequence
  Computer-generated peptide variant
KLKIIPRLLRLIRKLNPKGNRIGKLLLKVKAQYFRWAVLLQK

SEQ ID NO: 7243 - protein, 58 aa, Artificial Sequence
  Computer-generated peptide variant
LWKFYNKLLRRFKRGACFRQGRPLRSDKRMVSMVYSRAKARKAAQRCARRAALWDKNA

SEQ ID NO: 7244 - protein, 24 aa, Artificial Sequence
  Computer-generated peptide variant
LIKLWHKLIKKFKKNDLGRLKSAD

SEQ ID NO: 7245 - protein, 37 aa, Artificial Sequence
  Computer-generated peptide variant
FWRFWRRLLKFMNRRRCARSALQLKLNMWLLAAPRAR

SEQ ID NO: 7246 - protein, 93 aa, Artificial Sequence
  Computer-generated peptide variant
KMKLLRKLLRMLRREKVLMDGSKFIQRRLKPLEIARAHKICDKRLIRLHKRTRSALAHLNYALWKKIARFKQFRVFAAKLRNVRKVMIRKVMP

SEQ ID NO: 7247 - protein, 28 aa, Artificial Sequence
  Computer-generated peptide variant
RMKFLRRLLKKLQKFQFSMNRAYAESKL

SEQ ID NO: 7248 - protein, 50 aa, Artificial Sequence
  Computer-generated peptide variant
KMKFWRKYLRMWKRLQLFFPAIRFLLCRLFMLASAPKPRRDKKASHLTAR

SEQ ID NO: 7249 - protein, 69 aa, Artificial Sequence
  Computer-generated peptide variant
KWRLLKKFFKMLCKKMTLAILKKTRSVAYLRAYILLDCRIRQWAAKLNKALQLNFAELSKAIAKRHAAQ

SEQ ID NO: 7250 - protein, 66 aa, Artificial Sequence
  Computer-generated peptide variant
RMRMLTKFFKKIKKDLRILVALHRFLWDLRLKARRQDRLGGRGYAARKCRLLLQLAKWFCAKAKTK

SEQ ID NO: 7251 - protein, 24 aa, Artificial Sequence
  Computer-generated peptide variant
RLRYFRKMLKWLKHATEASYKAPR

SEQ ID NO: 7252 - protein, 63 aa, Artificial Sequence
  Computer-generated peptide variant
FYRLMSKMFRRWKRLRLAMADKAPPVRQRKRIGCAQYWLLHAKRGKRAHALTALDGRRPKLWL

SEQ ID NO: 7253 - protein, 23 aa, Artificial Sequence
  Computer-generated peptide variant
FFRWLKKMLKKYKKYLLYGQNLL

SEQ ID NO: 7254 - protein, 21 aa, Artificial Sequence
  Computer-generated peptide variant
MLRMFPRLMKLLPRAHRRKKL

SEQ ID NO: 7255 - protein, 33 aa, Artificial Sequence
  Computer-generated peptide variant
KIRIWQRLLKKFKSNMNRLDAKLSLLKSELARR

SEQ ID NO: 7256 - protein, 56 aa, Artificial Sequence
  Computer-generated peptide variant
FFRLLKKMFRLWQRRKLRQRWKTLFASSAWRARKNDMNLAYKRAIRLELKKWQLWN

SEQ ID NO: 7257 - protein, 39 aa, Artificial Sequence
  Computer-generated peptide variant
LLRWYRKYFKIFKTALYSKHRISLRTELALALLLLIRDK

SEQ ID NO: 7258 - protein, 57 aa, Artificial Sequence
  Computer-generated peptide variant
FLKMFKKFLKLMPSKKTVAEPLKNSCRWARRSMKAKARRKLACYNAALKLPFLLRNQ

SEQ ID NO: 7259 - protein, 31 aa, Artificial Sequence
  Computer-generated peptide variant
YLKLLQKFYRKIRPNRFKKAKRMIALVLRLL

SEQ ID NO: 7260 - protein, 56 aa, Artificial Sequence
  Computer-generated peptide variant
FLKFFRKMYRKLHKRDIKKANRTWLKKLAALARYAAWFNLIAVRLPKAERGRRQAK

SEQ ID NO: 7261 - protein, 60 aa, Artificial Sequence
  Computer-generated peptide variant
RYKWYQKYFRWFRQTADRMGALLTNKFRMKDTALASRWVKALLGVEKKRALKKGKLLCRL

SEQ ID NO: 7262 - protein, 25 aa, Artificial Sequence
  Computer-generated peptide variant
KIRLLRRLLKRMHTLTAVPLKKMLA

SEQ ID NO: 7263 - protein, 35 aa, Artificial Sequence
  Computer-generated peptide variant
RFKMLNKWLKKLRPLLLANAKMGWKNYACFRKAGS

SEQ ID NO: 7264 - protein, 45 aa, Artificial Sequence
  Computer-generated peptide variant
RLKYFCRLYRKWKRAAAAAVDHMFVKRTRCRTILATPANRLIRRE

SEQ ID NO: 7265 - protein, 62 aa, Artificial Sequence
  Computer-generated peptide variant
RIRLLPKLWKRIPRSEKRLDNCALLLALLALQPDPHTPLRPLLALRPKHGVRLLRKDMTRAI

SEQ ID NO: 7266 - protein, 100 aa, Artificial Sequence
  Computer-generated peptide variant
KFKYISKMYRLYPRLYRLLLHLKDRALLNTPTKRYCRLLRDRLKKKKKALALANKKLRARKLWKRWGNFDARGLTYPKRWTNLSKSEHTWQFHMAREIKL

SEQ ID NO: 7267 - protein, 24 aa, Artificial Sequence
  Computer-generated peptide variant
RLRLYSKFLKLFKHKLMKKHKNLA

SEQ ID NO: 7268 - protein, 25 aa, Artificial Sequence
  Computer-generated peptide variant
LYKLFRRFLKWYRCRELGRAKAVYQ

SEQ ID NO: 7269 - protein, 42 aa, Artificial Sequence
  Computer-generated peptide variant
YWRFLRKYWKKFRTLILTTNWRLKSAAKYARRMKYILKIALA

SEQ ID NO: 7270 - protein, 22 aa, Artificial Sequence
  Computer-generated peptide variant
RLKLLKRLYRKLKSLSRQAVYV

SEQ ID NO: 7271 - protein, 33 aa, Artificial Sequence
  Computer-generated peptide variant
RLKYLNKWFRKFKKAKLQALFAPMILLKRAMQQ

SEQ ID NO: 7272 - protein, 32 aa, Artificial Sequence
  Computer-generated peptide variant
LLRLWKRMWRYLRCCLKLHSLRAAKACTILTR

SEQ ID NO: 7273 - protein, 63 aa, Artificial Sequence
  Computer-generated peptide variant
LYKIWCRFLKFLKRRSRRRLRPYMKLAKAESYKGRAAMFKEAAMKAVCRCRAINKFLIAWLDD

SEQ ID NO: 7274 - protein, 53 aa, Artificial Sequence
  Computer-generated peptide variant
RLRWYRRLLKRYKQAVKQYRLRCEKAEAKEYLTLCLAYSQRRFKMHRDAYAAE

SEQ ID NO: 7275 - protein, 60 aa, Artificial Sequence
  Computer-generated peptide variant
LWKLWKRYLKRFNKEEMLAPSFRMKQRGREKLRPSLPRHLKLSKKKLSGAFDRLCAAKEK

SEQ ID NO: 7276 - protein, 42 aa, Artificial Sequence
  Computer-generated peptide variant
RFKIWRKFWRFYRKWKQRKYHLALHARLNLYQAQLRRAAKPN

SEQ ID NO: 7277 - protein, 94 aa, Artificial Sequence
  Computer-generated peptide variant
RYRLMHRFLKFLSSRQAYDWASRQPKIFMWALRRALNRQELTWSKMNKALKRAKLAFLLFELKRRPGVRARRLQGHAKRKLIVKRLEAPHRVKK

SEQ ID NO: 7278 - protein, 34 aa, Artificial Sequence
  Computer-generated peptide variant
LFKWIQRLWRKLRRHRACEWAKREQANALPAAAM

SEQ ID NO: 7279 - protein, 24 aa, Artificial Sequence
  Computer-generated peptide variant
KWKLLNRMMKKLSRADGAVFLKKL

SEQ ID NO: 7280 - protein, 29 aa, Artificial Sequence
  Computer-generated peptide variant
RLRLLRKFFRRLCKRDWRWAFCALRCLLH

SEQ ID NO: 7281 - protein, 41 aa, Artificial Sequence
  Computer-generated peptide variant
RYRMLRKYLRWFKTDFVRLKCPQAKMLLRGWRRLARLALLN

SEQ ID NO: 7282 - protein, 32 aa, Artificial Sequence
  Computer-generated peptide variant
KLKLWRKLYRLFKHGLGLRLKTKLTWLKSERF

SEQ ID NO: 7283 - protein, 43 aa, Artificial Sequence
  Computer-generated peptide variant
RLRLFKKLYKLWKCARKWKKNFTARQLGAFLKVRDMACRCAKV

SEQ ID NO: 7284 - protein, 30 aa, Artificial Sequence
  Computer-generated peptide variant
RYRFFQRLWKRFRKAPLLDCRLRGAADIDL

SEQ ID NO: 7285 - protein, 63 aa, Artificial Sequence
  Computer-generated peptide variant
YLKYLSRIYKLLHKPAKTEKALMSALLILQRSHSKCKLRHHARLRRAKGGFKLALGIAIKRQI

SEQ ID NO: 7286 - protein, 33 aa, Artificial Sequence
  Computer-generated peptide variant
KLRYLKRLMRWYKKCGKAVLNLELYLRDLAMKS

SEQ ID NO: 7287 - protein, 23 aa, Artificial Sequence
  Computer-generated peptide variant
KLKLLKKMFRWFRCLKELALLRG

SEQ ID NO: 7288 - protein, 39 aa, Artificial Sequence
  Computer-generated peptide variant
RFKWFRKFLRRLRHMLFHPASSATRLWAFAAMLKKFPAL

SEQ ID NO: 7289 - protein, 24 aa, Artificial Sequence
  Computer-generated peptide variant
LLRFMRRFMKKLQQLKAIAQRKFH

SEQ ID NO: 7290 - protein, 28 aa, Artificial Sequence
  Computer-generated peptide variant
MLKFYRKLLKRMTKAANKANVAMKTELQ

SEQ ID NO: 7291 - protein, 39 aa, Artificial Sequence
  Computer-generated peptide variant
WWRFLKRLLKFFKKKKCVLALKKKYNAFDVAKLQANFSL

SEQ ID NO: 7292 - protein, 47 aa, Artificial Sequence
  Computer-generated peptide variant
RIKWYKRLLKYLRKAQRDKKQFWRAFWWRLRLRLLKLAVRPDLVWRL

SEQ ID NO: 7293 - protein, 22 aa, Artificial Sequence
  Computer-generated peptide variant
RMRLLRKFMKMFKHLQALQKAK

SEQ ID NO: 7294 - protein, 23 aa, Artificial Sequence
  Computer-generated peptide variant
KFRLLKKLWRLFNKKLWQLKRQA

SEQ ID NO: 7295 - protein, 71 aa, Artificial Sequence
  Computer-generated peptide variant
LMKWWNKLMRKLPNKDELDPGRAPARLPRTRTAARKLRKFKLNAKKLLVIAGTALPCKDCLDETVAAWRAR

SEQ ID NO: 7296 - protein, 36 aa, Artificial Sequence
  Computer-generated peptide variant
LLRFLRKLLRYLKRKWKELDMHELNKCAHHRNRSKQ

SEQ ID NO: 7297 - protein, 90 aa, Artificial Sequence
  Computer-generated peptide variant
RWRLFRKFLKFMPNALRKEEMHKTCDKRYAAAAHPKIAWVKAATLLIYKAAKLGANPAGKLSWSHIKMHFKKLRLNAKRAIAFALERLAE

SEQ ID NO: 7298 - protein, 41 aa, Artificial Sequence
  Computer-generated peptide variant
KYRMMQRLWKWYRRLKRRIAELACKRAFAKILMILLLIVYD

SEQ ID NO: 7299 - protein, 27 aa, Artificial Sequence
  Computer-generated peptide variant
LMRLWTRWIKKLKRRIFRAAALARAWP

SEQ ID NO: 7300 - protein, 22 aa, Artificial Sequence
  Computer-generated peptide variant
LWRFYRRYFKLLRPLLRKRLLM

SEQ ID NO: 7301 - protein, 31 aa, Artificial Sequence
  Computer-generated peptide variant
LLRLFKKLYRKFKRLSESDCVVYFAAIKLLK

SEQ ID NO: 7302 - protein, 21 aa, Artificial Sequence
  Computer-generated peptide variant
FLKLLHRLMKKFRKKVKLDIA

SEQ ID NO: 7303 - protein, 91 aa, Artificial Sequence
  Computer-generated peptide variant
RLRWIRKLFRRYSRNNHMEHCESMNLENSIKLKIRAWANRRSVKRLKALKLAPALKKHLARRIAHRNGRFQISPALTMRAALKKALARCGL

SEQ ID NO: 7304 - protein, 77 aa, Artificial Sequence
  Computer-generated peptide variant
RFKIFKKLWRFLRKWQGHVRLKLALLKADSFGMGARLRLDRQTFGFYRGGWRAKKEQALQKARTCEARYALRKQAKL

SEQ ID NO: 7305 - protein, 29 aa, Artificial Sequence
  Computer-generated peptide variant
RLKWLCKIIKKFKKCSAAPHLDLKLRLAR

SEQ ID NO: 7306 - protein, 46 aa, Artificial Sequence
  Computer-generated peptide variant
MFRLFKKFIKLLKCWKAKTYGKHAKLVRLKRLKILSSCCKNASAIA

SEQ ID NO: 7307 - protein, 86 aa, Artificial Sequence
  Computer-generated peptide variant
RIKLYKRFWRKWKQKRSSSPLLDIAWLLCRMRVGCMLYATYAKAKMAKLDAQWLRNFMRLKGWNLFCKTAKTRKLLRGVAKKALLK

SEQ ID NO: 7308 - protein, 23 aa, Artificial Sequence
  Computer-generated peptide variant
KFRWLKRWLRYLRKKAARAKLML

SEQ ID NO: 7309 - protein, 20 aa, Artificial Sequence
  Computer-generated peptide variant
ILRLFRRLLRWFPKIRRAFA

SEQ ID NO: 7310 - protein, 40 aa, Artificial Sequence
  Computer-generated peptide variant
KLKLLRRLLKFLCKLYCKQSRYTRNHALLRLASFAAKENL

SEQ ID NO: 7311 - protein, 65 aa, Artificial Sequence
  Computer-generated peptide variant
WLKLLRRLFRKWRPCPRYRSLTKAGKACAACLLKAKVLLPAQYCRFGPFRMAHRIKKGKGVMDAK

SEQ ID NO: 7312 - protein, 28 aa, Artificial Sequence
  Computer-generated peptide variant
RMRLIKKLWRRFSKDAPGRLCMAARFAW

SEQ ID NO: 7313 - protein, 62 aa, Artificial Sequence
  Computer-generated peptide variant
KLRFLQKFLRRIRRSNLALIAGEDRSPLRRLRLFKRNLACHAGGKLAQGRGAATKARKFLLL

SEQ ID NO: 7314 - protein, 26 aa, Artificial Sequence
  Computer-generated peptide variant
LIKFLHKMIRRLKTAKKPAWVLATYA

SEQ ID NO: 7315 - protein, 29 aa, Artificial Sequence
  Computer-generated peptide variant
RYKLLKKMMRRFKTLYCALAKLMRWAKAR

SEQ ID NO: 7316 - protein, 38 aa, Artificial Sequence
  Computer-generated peptide variant
LYRFLRKLMRRLHKSWRDRFYYARMRHKRAMALLMLDA

SEQ ID NO: 7317 - protein, 81 aa, Artificial Sequence
  Computer-generated peptide variant
YMRLFQRLWRLFTHRKKIAIEYAAYFWCAKKKCARIDRKSEKHKRKRLLWRTWKLRFRSACLACRLRAKPWCMLLALIRVG

SEQ ID NO: 7318 - protein, 36 aa, Artificial Sequence
  Computer-generated peptide variant
KLKFFSKILKLLKKHKLADNRHLWKYILRPALKAAA

SEQ ID NO: 7319 - protein, 30 aa, Artificial Sequence
  Computer-generated peptide variant
RWKIWTKLMKWLKKRNAAESRREWQLWRAL

SEQ ID NO: 7320 - protein, 49 aa, Artificial Sequence
  Computer-generated peptide variant
KLKWFKRIFKLFKKVAARLQKLQLLKAKQDKKKQICQWEPLQALLDAAY

SEQ ID NO: 7321 - protein, 56 aa, Artificial Sequence
  Computer-generated peptide variant
RLKLFRRLFKLMQKDKIADHMLLFLAFNKPHLKRCSALRKGCVLRSLRLQMRAEKI

SEQ ID NO: 7322 - protein, 32 aa, Artificial Sequence
  Computer-generated peptide variant
KYRFIRRLLRFFRKKWLFALARSACALKTAAQ

SEQ ID NO: 7323 - protein, 44 aa, Artificial Sequence
  Computer-generated peptide variant
YIKFYCKFYKKMKREKEGALDLLAAAGYKKRRFAVAAKPPKLLG

SEQ ID NO: 7324 - protein, 20 aa, Artificial Sequence
  Computer-generated peptide variant
RFRLLPKILRFLSCLQREQR

SEQ ID NO: 7325 - protein, 43 aa, Artificial Sequence
  Computer-generated peptide variant
KLRYLQRLLRKWKKSETAASKAISCALAEPLFWEKVARLKRLR

SEQ ID NO: 7326 - protein, 45 aa, Artificial Sequence
  Computer-generated peptide variant
RFKYMKKLWRLLTPLTRSLATLKPLSAYAYKRLNSKAARLGAKWL

SEQ ID NO: 7327 - protein, 40 aa, Artificial Sequence
  Computer-generated peptide variant
LLKIFPKMIRRLKRTKNYMWKHARLAALLQSKDDAAKQVG

SEQ ID NO: 7328 - protein, 34 aa, Artificial Sequence
  Computer-generated peptide variant
KLKYFRKFLRKLKCTLAAEIAIELRLAKRHKTAY

SEQ ID NO: 7329 - protein, 41 aa, Artificial Sequence
  Computer-generated peptide variant
KFKFLSKLLRKMPKQLLRCPKKLNCRELQIIRSCLLLKLHC

SEQ ID NO: 7330 - protein, 45 aa, Artificial Sequence
  Computer-generated peptide variant
RFKFYKKLWKRWRSLPALACPHKRSGLRRHTWLRKAAKFMAARAW

SEQ ID NO: 7331 - protein, 78 aa, Artificial Sequence
  Computer-generated peptide variant
LWRFFRRLLRIMKRSQAAARLAHRKKPAAGLDLKRCYQAQIAVWALAIKISAPAMSEHEKYLRYLAHRQEMHRRNLKA

SEQ ID NO: 7332 - protein, 30 aa, Artificial Sequence
  Computer-generated peptide variant
RLRFLRKFWRIYRHKTRRCLWRLLVQPAAG

SEQ ID NO: 7333 - protein, 50 aa, Artificial Sequence
  Computer-generated peptide variant
LFRYIRKIWRKYRHPKLVRAKLWTRLRYNTPMALMKAKSRAPLHARWLRD

SEQ ID NO: 7334 - protein, 33 aa, Artificial Sequence
  Computer-generated peptide variant
KLKLLKKYLRRFKRCRKANYAMAARHCIMADVR

SEQ ID NO: 7335 - protein, 65 aa, Artificial Sequence
  Computer-generated peptide variant
LLKILHKLYKKLPSSDLCALARSFRSKPIAVHRAERMKHRWMRADKLVCLKKIWQKAKARAKFLW

SEQ ID NO: 7336 - protein, 96 aa, Artificial Sequence
  Computer-generated peptide variant
FLKYMHKLLRKLRRAHLARVKALHTVALVKLCAAKKSLEKDGQLLKLKRETIAKNQQAWRQDAACAHFTVWLLKHLGRRRAMYMARAAMIRWLQRR

SEQ ID NO: 7337 - protein, 38 aa, Artificial Sequence
  Computer-generated peptide variant
KLRLYSKLLRFIKRLAAEHYKLAFNRVKRRVAHQFMRN

SEQ ID NO: 7338 - protein, 54 aa, Artificial Sequence
  Computer-generated peptide variant
LIKLMRRYLRMLTKAGATEARLKEQLATAGRKELAKNDKDLRLKAGAGTTKGLN

SEQ ID NO: 7339 - protein, 28 aa, Artificial Sequence
  Computer-generated peptide variant
RLKLFRKWLRRYKTKCLAALLFRFHHWL

SEQ ID NO: 7340 - protein, 24 aa, Artificial Sequence
  Computer-generated peptide variant
IYRLMRKILKKLRRWLRLLVSAER

SEQ ID NO: 7341 - protein, 65 aa, Artificial Sequence
  Computer-generated peptide variant
IMKYLSRMWRFFRSLLPLRHGAIRAIRHQNRAPRSLKAKARKKAKRALTAEKLIFRVLELKPTSE

SEQ ID NO: 7342 - protein, 40 aa, Artificial Sequence
  Computer-generated peptide variant
RWRLLHKLMKKIRKKKIGLHEPPHAFHKKARWANQRLSEL

SEQ ID NO: 7343 - protein, 42 aa, Artificial Sequence
  Computer-generated peptide variant
KMKWLRRMLRFFRCRELKKPAGRRERLRLADDCLKMPNLAMA

SEQ ID NO: 7344 - protein, 36 aa, Artificial Sequence
  Computer-generated peptide variant
KLKLLNRILRIFRKHWACQLKMKMRELRLGKIAHTD

SEQ ID NO: 7345 - protein, 73 aa, Artificial Sequence
  Computer-generated peptide variant
YMRFIRRFFRKFHKLKGEFAKADARLLKQVVAFATDRRAKKGLGARQCLSLKRLKRLALDAALPCQLFAWLYA

SEQ ID NO: 7346 - protein, 72 aa, Artificial Sequence
  Computer-generated peptide variant
KWRWWKRYYRLMSKRYKLVLARPRLCSHKISQLDDRALFTLRRHAALCRRKVLILDCRQWKKKPRRLIHLLR

SEQ ID NO: 7347 - protein, 43 aa, Artificial Sequence
  Computer-generated peptide variant
KLKFFCRLYKKIRNIAVVLWLRRLFVLRKALTQTPRLYGLLIR

SEQ ID NO: 7348 - protein, 20 aa, Artificial Sequence
  Computer-generated peptide variant
RLKLLHRLLKYLRCFNGACG

SEQ ID NO: 7349 - protein, 21 aa, Artificial Sequence
  Computer-generated peptide variant
WLKFLRKLFRFLKKKSAKAVC

SEQ ID NO: 7350 - protein, 21 aa, Artificial Sequence
  Computer-generated peptide variant
KLKFLHRLMKKYSKAHAEREQ

SEQ ID NO: 7351 - protein, 23 aa, Artificial Sequence
  Computer-generated peptide variant
FLKFLKRLWKRFNRAKWKEAWCA

SEQ ID NO: 7352 - protein, 31 aa, Artificial Sequence
  Computer-generated peptide variant
RIRLFHKLLRFYKQLLAERSLIGLKALSQIR

SEQ ID NO: 7353 - protein, 48 aa, Artificial Sequence
  Computer-generated peptide variant
KIRLMKKLLKMFKPAYVKLLPAEQIAAKLVAKRKIQDKAGQFRLFAKQ

SEQ ID NO: 7354 - protein, 71 aa, Artificial Sequence
  Computer-generated peptide variant
YIKYFRKLFKKYKSLCLRDMMKRWRLEAECGRAYYRKKNLLVRQAAPFAAKEKNREYAADAMRYAKPLLAA

SEQ ID NO: 7355 - protein, 40 aa, Artificial Sequence
  Computer-generated peptide variant
FLKLWNRFLRKLKRMDREDLLRRMKRLNDIILGQPIQARR

SEQ ID NO: 7356 - protein, 20 aa, Artificial Sequence
  Computer-generated peptide variant
KIKLLQRLLKRMTCLSPARW

SEQ ID NO: 7357 - protein, 52 aa, Artificial Sequence
  Computer-generated peptide variant
KLKLFRRFLKFFKPGLLAFTVFWFLAKSSYAAARALRRHWGIAKKRDRRGAK

SEQ ID NO: 7358 - protein, 36 aa, Artificial Sequence
  Computer-generated peptide variant
KWKILQRIFKKLRHLYTTASRAMLLEKALKLAWPTA

SEQ ID NO: 7359 - protein, 46 aa, Artificial Sequence
  Computer-generated peptide variant
KLKFLSKYWKRFRKKLLILAYRKQDRANKTTWHKLERVTPAAAKNV

SEQ ID NO: 7360 - protein, 21 aa, Artificial Sequence
  Computer-generated peptide variant
LYRMLHRLFRLLKRQKTLARC

SEQ ID NO: 7361 - protein, 44 aa, Artificial Sequence
  Computer-generated peptide variant
IFKFICRLLRKIKRDALRMTRRRWLALSLLLKRLDAACLHVGPS

SEQ ID NO: 7362 - protein, 25 aa, Artificial Sequence
  Computer-generated peptide variant
RMKMYKKLYKKLKRLKHEASFLLLT

SEQ ID NO: 7363 - protein, 24 aa, Artificial Sequence
  Computer-generated peptide variant
IFRLITRWLKKFRRCIQQLLLLKR

SEQ ID NO: 7364 - protein, 49 aa, Artificial Sequence
  Computer-generated peptide variant
FLRWLSKLFKRLHRSPMRHRIALEAARMAPRAVNLAKAHYWKKRLIHDA

SEQ ID NO: 7365 - protein, 24 aa, Artificial Sequence
  Computer-generated peptide variant
LMRLFKKILRILKRLNRLCNCKLK

SEQ ID NO: 7366 - protein, 57 aa, Artificial Sequence
  Computer-generated peptide variant
LLRIWRKIFRKWQKDCLHPRAIIAHRKKDKSLTKLIKVAARQNAACFARLMRKCVRA

SEQ ID NO: 7367 - protein, 45 aa, Artificial Sequence
  Computer-generated peptide variant
WLKLFKRFMKFLSKRKLGGASARRRAARAVRAMACLKDDGLLGGK

SEQ ID NO: 7368 - protein, 56 aa, Artificial Sequence
  Computer-generated peptide variant
KLRFFKRWFRLWRRSLAKGALKRLWSLTRMCAKSPLVMEAKDIVCARGKQRPARPR

SEQ ID NO: 7369 - protein, 92 aa, Artificial Sequence
  Computer-generated peptide variant
KFKFWRKYLRKLSKLYKNLAKNLDWRAMSPKSMKKTYKALAIMTLNRRSWLKLRLYWWQARRTAKRYRAARTKKKLRALLKLNLMRCLKEPM

SEQ ID NO: 7370 - protein, 58 aa, Artificial Sequence
  Computer-generated peptide variant
KLRLICRLLKFFNKLAYKKLPKGRELLLCCMCLWLKIANYRKNLDALQRFRRNKRMRS

SEQ ID NO: 7371 - protein, 80 aa, Artificial Sequence
  Computer-generated peptide variant
KMKYWKKLLKKYPSCLKEAGAKTKAEPAMALLNLLMRKKQCKLKKKLTLTAFLWSLVKLIKMTYVRMKAFRAKRISSKKK

SEQ ID NO: 7372 - protein, 41 aa, Artificial Sequence
  Computer-generated peptide variant
MLKWLHRLLRMMPSADGKPLKLAQCRLNRRLRLIEQNELKA

SEQ ID NO: 7373 - protein, 94 aa, Artificial Sequence
  Computer-generated peptide variant
RLKMLRKFMRRLKKSTLKTALLKLEALKKKFLRMKAWHIRLLALLCRRRMMEGYVALHYAPSLKDMDDIKNLEKGLADKLAYESELWHLKWVQL

SEQ ID NO: 7374 - protein, 26 aa, Artificial Sequence
  Computer-generated peptide variant
RMKWLKKWLRKLRQYQRPGLAAAIEP

SEQ ID NO: 7375 - protein, 25 aa, Artificial Sequence
  Computer-generated peptide variant
LIRWLRKMYRILQTLIARKAERRYA

SEQ ID NO: 7376 - protein, 34 aa, Artificial Sequence
  Computer-generated peptide variant
LLRMMQRLIKKFHRNTKACDAGDLAFKSALCRLL

SEQ ID NO: 7377 - protein, 73 aa, Artificial Sequence
  Computer-generated peptide variant
MFKWYRKFLRRIKSWQVSRLMNRAFTMAALMAFAARMFRNRYLAAKQMRPKFRNQHAASRAKWNRRLARRAKA

SEQ ID NO: 7378 - protein, 55 aa, Artificial Sequence
  Computer-generated peptide variant
KWRLIRKLLRFIKTVWADKDLLEKLRLDKSYLTARLFALLALMASDLKKSPPQTT

SEQ ID NO: 7379 - protein, 23 aa, Artificial Sequence
  Computer-generated peptide variant
KLRYLKKLFRKYSKELTSQNILL

SEQ ID NO: 7380 - protein, 32 aa, Artificial Sequence
  Computer-generated peptide variant
RLRLFHRYFKKLRCRFKTIERARLAAWAWYLH

SEQ ID NO: 7381 - protein, 74 aa, Artificial Sequence
  Computer-generated peptide variant
RFKMLNKLFRWLTKASACSHRIKNGQLRALKIWKELRFRLHLLKLQMTAKVVRLFGAARPKSFAEKAKYRFKKR

SEQ ID NO: 7382 - protein, 99 aa, Artificial Sequence
  Computer-generated peptide variant
RLRLFCKFMKRWKKLKKRRRKRLYCQALWATLRCDAYLKALWNKLTDSRIRYLRILMRRTLIAALSDWIRPKWLRAHGLRWLRASWLHNWIFKERATGL

SEQ ID NO: 7383 - protein, 41 aa, Artificial Sequence
  Computer-generated peptide variant
RFRMMSKYFKYFKKDLRLLKAFLLARRLTRAVRELAQEKAY

SEQ ID NO: 7384 - protein, 28 aa, Artificial Sequence
  Computer-generated peptide variant
WLRLIRKFLKIYRPNCSLKAAPRNWKAA

SEQ ID NO: 7385 - protein, 67 aa, Artificial Sequence
  Computer-generated peptide variant
KMRYLKKLLKKWPKRLSSALKAARCLQIRHVKRAFAVPKNRAFGLGQKADKQRGDAILKLILLRKAA

SEQ ID NO: 7386 - protein, 60 aa, Artificial Sequence
  Computer-generated peptide variant
LLKIFRRIMRKFQRAVYKRTIFQRPLWRHLLFKCSQADLRRLRELLTLRYLQYAKVPLAR

SEQ ID NO: 7387 - protein, 53 aa, Artificial Sequence
  Computer-generated peptide variant
IYKFLKRLWRKLRRLLLHIAAKHCEKLKIGNRSYPRLECKPVLKLRYTRLTGL

SEQ ID NO: 7388 - protein, 79 aa, Artificial Sequence
  Computer-generated peptide variant
RLKLIKRIFRWMRKTQQWFTIKKIALLSAFSKLRYKWRYFKCALTRLKLKLLANRDATRGRLAALLIYLLRVKQILTYW

SEQ ID NO: 7389 - protein, 41 aa, Artificial Sequence
  Computer-generated peptide variant
RIRFMRRLFRRMKPLMTKHKLLHLKVTSAALEARPLVGIAA

SEQ ID NO: 7390 - protein, 42 aa, Artificial Sequence
  Computer-generated peptide variant
MWKILKKLMRRYTKALVALPAKKHLFQGRKDALHLQLCKHAS

SEQ ID NO: 7391 - protein, 83 aa, Artificial Sequence
  Computer-generated peptide variant
RMRFLNRFIKKMCQKLARFTRLRSALAFKNAGRRSRTFLYRRIWLQHALLKNLCRDRLLARGTRRKNALLRSDKDKCECAAYS

SEQ ID NO: 7392 - protein, 28 aa, Artificial Sequence
  Computer-generated peptide variant
LLKMLRKLMRFIRQAEAFLKVSAKAKQK

SEQ ID NO: 7393 - protein, 52 aa, Artificial Sequence
  Computer-generated peptide variant
RYKWFQKIFKRWKNRFRYKHNLDLLKEHKRAAIAQALLFRCPSLKAAEKALR

SEQ ID NO: 7394 - protein, 32 aa, Artificial Sequence
  Computer-generated peptide variant
FFRILKRWLKWLQKLVLCAKRARSRQSILFRI

SEQ ID NO: 7395 - protein, 70 aa, Artificial Sequence
  Computer-generated peptide variant
RIRYLRRLIKKFRSMLNLAMAVRRASLFHYRYARLATQAFLANLALGKKRIWAKEKKCKTSRWAMMRGTK

SEQ ID NO: 7396 - protein, 64 aa, Artificial Sequence
  Computer-generated peptide variant
FLKYIRRYFKRLRRAANALALSANLAARKKRPTAPKIYAKERYNDAKKTARIQFLCRMKKCEFT

SEQ ID NO: 7397 - protein, 30 aa, Artificial Sequence
  Computer-generated peptide variant
YLRLMKKLMRRYKKIKELLNFAADAVLNAL

SEQ ID NO: 7398 - protein, 55 aa, Artificial Sequence
  Computer-generated peptide variant
RYKILPRLFRKFSRHFRGLAFAYRAKAAYLEKLKAREAARDGDIAKFKPRMTRKE

SEQ ID NO: 7399 - protein, 77 aa, Artificial Sequence
  Computer-generated peptide variant
KFKLMSRIFRKIQRYRQGRKTRRLKLAGMQSLRAVLARRPLHLVEFGAKFRAMACHVRPLSRRRGAEKCAEAKLRFL

SEQ ID NO: 7400 - protein, 50 aa, Artificial Sequence
  Computer-generated peptide variant
YIRYLKRLLKKLKNANQEPTAAKLPKARWLKDARAKMYPEMTRRRTAPDR

SEQ ID NO: 7401 - protein, 40 aa, Artificial Sequence
  Computer-generated peptide variant
WIKILHRLFKLLPSKERIALMILKSQYRKAIRWLKKAMAY

SEQ ID NO: 7402 - protein, 28 aa, Artificial Sequence
  Computer-generated peptide variant
MIRLLRRLLKYYHRLGKARTFRLGKVGP

SEQ ID NO: 7403 - protein, 21 aa, Artificial Sequence
  Computer-generated peptide variant
KFRIITKFLKKLRSLLLYIKD

SEQ ID NO: 7404 - protein, 61 aa, Artificial Sequence
  Computer-generated peptide variant
IMKMLRRFFRIYKNAHRKAYKLWRLWKREDMRSNLTAVVKAALKRRLVLRITLAKATWTKP

SEQ ID NO: 7405 - protein, 20 aa, Artificial Sequence
  Computer-generated peptide variant
LLKLIKKFYRFITREQMLRL

SEQ ID NO: 7406 - protein, 87 aa, Artificial Sequence
  Computer-generated peptide variant
YFRIWRRWYRFYRKQGQLFKAAAHALKLLGMRMMAEAKKITLCKYFHRKRALWLLEKKAKYRLLWYSLKELGAKNAKLLTGKCMAPQ

SEQ ID NO: 7407 - protein, 33 aa, Artificial Sequence
  Computer-generated peptide variant
MLRLLRRLLKKLTHLLIKRNKKDCRILRQRIYQ

SEQ ID NO: 7408 - protein, 41 aa, Artificial Sequence
  Computer-generated peptide variant
LIRLYRRYFKRLKCRDDKAAVLVAPLLLLRARRYLAISKLV

SEQ ID NO: 7409 - protein, 59 aa, Artificial Sequence
  Computer-generated peptide variant
RLKFLRRLLKIYRRLEACNFVAGARKKDLRTRGLIDARPSAAIALLATRYTCRQHFYRL

SEQ ID NO: 7410 - protein, 47 aa, Artificial Sequence
  Computer-generated peptide variant
KLRFIKKIIRILRPRAMRARMLDLRGTARLNRERGQGKAAALHCYMD

SEQ ID NO: 7411 - protein, 22 aa, Artificial Sequence
  Computer-generated peptide variant
YLKWLSKILRKLCRLFKLCSCR

SEQ ID NO: 7412 - protein, 100 aa, Artificial Sequence
  Computer-generated peptide variant
KIRYMSKILRRISPHTCKSRKLGKLLTKHRKSRKRFKAAARLACYMADRAQHALCRCLFARWWKCIERKKALTAKKAKAIRAQKAARTFRLADREPLQAP

SEQ ID NO: 7413 - protein, 34 aa, Artificial Sequence
  Computer-generated peptide variant
RMRFLQKFLKRYKRLYNFRTWKRLAWAKEAFGCA

SEQ ID NO: 7414 - protein, 78 aa, Artificial Sequence
  Computer-generated peptide variant
KMKWLRKFFRRFRHACTLAKIKKDAAVRLRLWLLLAGFKQCALPIIMYARRRWKHAEWNEDRAKTGKGAKLLCIYRLE

SEQ ID NO: 7415 - protein, 23 aa, Artificial Sequence
  Computer-generated peptide variant
RLRFLSKYYRLLTRALKARDTAV

SEQ ID NO: 7416 - protein, 27 aa, Artificial Sequence
  Computer-generated peptide variant
MLKFLSRYYKWIKKLLWAARRAMKDVM

SEQ ID NO: 7417 - protein, 27 aa, Artificial Sequence
  Computer-generated peptide variant
KFRWLKKMFKKLKHPPAALLLADFRGH

SEQ ID NO: 7418 - protein, 40 aa, Artificial Sequence
  Computer-generated peptide variant
RWRWFKKLFKKLKKAYQADRLIAKMKLLYPAKAKQFRWAL

SEQ ID NO: 7419 - protein, 41 aa, Artificial Sequence
  Computer-generated peptide variant
KLRLYSRLMRLWQRGNQSLARGAEKFRKAKSLDSLKIKGYA

SEQ ID NO: 7420 - protein, 71 aa, Artificial Sequence
  Computer-generated peptide variant
RLKLLQRYLRLYRRTNLKFRMVTRRATNQVTVDAWAYNASKCKDHRAKLGQKAVAARRRKFRLKFLRFLPQ

SEQ ID NO: 7421 - protein, 22 aa, Artificial Sequence
  Computer-generated peptide variant
RLKFFRKMLKKMSRAAYYKLAA

SEQ ID NO: 7422 - protein, 32 aa, Artificial Sequence
  Computer-generated peptide variant
RMKFLHKFLRRLHRKKKALTSLRKYVAAESEW

SEQ ID NO: 7423 - protein, 23 aa, Artificial Sequence
  Computer-generated peptide variant
LLRFFRKFFKKLKQAILCLKAKK

SEQ ID NO: 7424 - protein, 32 aa, Artificial Sequence
  Computer-generated peptide variant
RFKLLKRFFRYLRKWLLPRQWIKFALKVRTEL

SEQ ID NO: 7425 - protein, 36 aa, Artificial Sequence
  Computer-generated peptide variant
RYKLIHKYLRFLRKPDKLAKQAKLINMAFAALHQKR

SEQ ID NO: 7426 - protein, 44 aa, Artificial Sequence
  Computer-generated peptide variant
RLKYYQRYMRRLCRRLRKHGNGRLQTAYHHMLRADKLLSASKAK

SEQ ID NO: 7427 - protein, 69 aa, Artificial Sequence
  Computer-generated peptide variant
RFKFFKRLLRLLRTKPRATMNTDECVAAQLLAPKAPLLLKRRPKADFNCRDERFLTKALMPAWSNAAKP

SEQ ID NO: 7428 - protein, 51 aa, Artificial Sequence
  Computer-generated peptide variant
FLRYLRKILKRFRKKAEIAYFSRTRCLTALKWRLYLTVACKMPRDARKAKK

SEQ ID NO: 7429 - protein, 32 aa, Artificial Sequence
  Computer-generated peptide variant
KLRLYRKWLRLMHHYSRKLNNKTKLAVAAHIE

SEQ ID NO: 7430 - protein, 21 aa, Artificial Sequence
  Computer-generated peptide variant
FFRLFHKLLKKLRRKCVALNH

SEQ ID NO: 7431 - protein, 51 aa, Artificial Sequence
  Computer-generated peptide variant
RYKLFNRFYRFLRKKDGKLKITARAEVLRIDAKRGRTLLDKGKCFARALND

SEQ ID NO: 7432 - protein, 66 aa, Artificial Sequence
  Computer-generated peptide variant
RLKMYRRFLRKMRRGLFVPAKADKNEWRRARAHLANLQMFKPKAACIDKMFAHLRPALGMIALAAI

SEQ ID NO: 7433 - protein, 57 aa, Artificial Sequence
  Computer-generated peptide variant
RMRFMKKFLKRFRRLKKALLGAYTRQVLKAHMLKMTIDIARLKHVAKRDLSAARAAH

SEQ ID NO: 7434 - protein, 42 aa, Artificial Sequence
  Computer-generated peptide variant
KYRFLKRLFRRLHHYYIALAAKETLTAKQLDPRALIDRAAPK

SEQ ID NO: 7435 - protein, 60 aa, Artificial Sequence
  Computer-generated peptide variant
LFKLLNKILKKFCRSAAAAAKSYLYWKFPVQRILYRAWLLRRVKEFLWRMRLWLASRFKI

SEQ ID NO: 7436 - protein, 40 aa, Artificial Sequence
  Computer-generated peptide variant
KLRWLNRLLRKMKRAKIMQWRALLAYICRLLDPRIAWYGL

SEQ ID NO: 7437 - protein, 95 aa, Artificial Sequence
  Computer-generated peptide variant
KMKMITRFLRFLRRSLLLARTARFFEWKFYKTCLRKFARSLVAARASCTRAPRNNALNYCLRATRAACKRAIFRKIAARWVARRSELHRQLFWRY

SEQ ID NO: 7438 - protein, 22 aa, Artificial Sequence
  Computer-generated peptide variant
ILRFLSKYYRKLRRKAADALYT

SEQ ID NO: 7439 - protein, 22 aa, Artificial Sequence
  Computer-generated peptide variant
FLKFFTRFWRRIRRAAMAARLA

SEQ ID NO: 7440 - protein, 24 aa, Artificial Sequence
  Computer-generated peptide variant
FLKFFPKLLKKLRKAASLVCGCKR

SEQ ID NO: 7441 - protein, 25 aa, Artificial Sequence
  Computer-generated peptide variant
KLKILKKIYKFFPKLLTAKCSPLLM

SEQ ID NO: 7442 - protein, 40 aa, Artificial Sequence
  Computer-generated peptide variant
RLRLINKILRMLKRLYAGQWLFLQCLHLRAKKCKEDARRR

SEQ ID NO: 7443 - protein, 58 aa, Artificial Sequence
  Computer-generated peptide variant
KYKMYRKLFKYLKKKALLKKWRRRISDNSQVRLLAQYKHARCAWPLKTPRRLPLLAPR

SEQ ID NO: 7444 - protein, 35 aa, Artificial Sequence
  Computer-generated peptide variant
RMKLICKLMRLFSKLARKKTLVQCNAKLKLAKAGK

SEQ ID NO: 7445 - protein, 48 aa, Artificial Sequence
  Computer-generated peptide variant
LLRFLTRLYKRYKKFALAKPRKEKDHRKLELARVHHMFSAAAAVLIRQ

SEQ ID NO: 7446 - protein, 43 aa, Artificial Sequence
  Computer-generated peptide variant
IMKLLQKLLKKINRIFISAKRQGKKARRMEVPAKQYKLRHAEL

SEQ ID NO: 7447 - protein, 54 aa, Artificial Sequence
  Computer-generated peptide variant
KYKYYSRLLRMWRRLKKAPCWPRIMALRLKRTNLYRKAHPLAINEKKFLYELNR

SEQ ID NO: 7448 - protein, 20 aa, Artificial Sequence
  Computer-generated peptide variant
YFRLFQRLFKRFKKAHMTLA

SEQ ID NO: 7449 - protein, 36 aa, Artificial Sequence
  Computer-generated peptide variant
KFRFLKKLIKFMKRVKARQPKAAFFADFIATIAEKL

SEQ ID NO: 7450 - protein, 28 aa, Artificial Sequence
  Computer-generated peptide variant
KFRMITRLLKFFKSLAAARDHRAFNANK

SEQ ID NO: 7451 - protein, 45 aa, Artificial Sequence
  Computer-generated peptide variant
FMKLFCKILKLLKRNNLSHKFTKCRRRRANNKKCDQYVLLLKAQA

SEQ ID NO: 7452 - protein, 26 aa, Artificial Sequence
  Computer-generated peptide variant
RWKFFRRMWKILSKKARLHLTDACAL

SEQ ID NO: 7453 - protein, 41 aa, Artificial Sequence
  Computer-generated peptide variant
KLKLFKRFIKKICRRVCKCGRAALALYQELALTRRAYVGCS

SEQ ID NO: 7454 - protein, 25 aa, Artificial Sequence
  Computer-generated peptide variant
YLKWLRRWLRWMNKNLLTMTRWKLR

SEQ ID NO: 7455 - protein, 25 aa, Artificial Sequence
  Computer-generated peptide variant
KFRFYRRLYKRLNTNERMKQQALAL

SEQ ID NO: 7456 - protein, 64 aa, Artificial Sequence
  Computer-generated peptide variant
KFRMIKKLFKLYKHTKLTLRRKLLARITWGRLELRCMEKEMPARAAWRASAKFFKKIYAKWQRA

SEQ ID NO: 7457 - protein, 66 aa, Artificial Sequence
  Computer-generated peptide variant
KLRIYKRMFRRLQKVEKLLRKRLFRKKPRFAHPAARRGMKTLGFKKDVSLGMLLGGSLKELALLSL

SEQ ID NO: 7458 - protein, 85 aa, Artificial Sequence
  Computer-generated peptide variant
RFKFLKKWLRRWRRRYLLSLACREIKVALRIDHKGLLHLCRQDTKVAKREAGVKRGELAPGATRQKNALGYAALKARSHKKAFKG

SEQ ID NO: 7459 - protein, 46 aa, Artificial Sequence
  Computer-generated peptide variant
LMRMMKKLLRKWKRAARMACRTLRDRLIDSPDGLILHKLNAELIRS

SEQ ID NO: 7460 - protein, 41 aa, Artificial Sequence
  Computer-generated peptide variant
LFKILCRLWKKFCKKLMLVLRLKPLARIVCFPLARQTNKDL

SEQ ID NO: 7461 - protein, 21 aa, Artificial Sequence
  Computer-generated peptide variant
LFRFYNKLFKRLPKARRNAFE

SEQ ID NO: 7462 - protein, 49 aa, Artificial Sequence
  Computer-generated peptide variant
FYKIFHKMLRLFRHELMPKRKGLLLKKLHPALKKLLLQHAYRKYLHNKV

SEQ ID NO: 7463 - protein, 48 aa, Artificial Sequence
  Computer-generated peptide variant
LYKYIKRLWRKLKKAANAAFEACRWRLARLRRTKFQLATRLNILKHAI

SEQ ID NO: 7464 - protein, 38 aa, Artificial Sequence
  Computer-generated peptide variant
IWRYYCRFLKKLRQAFFDLLVKRFAKRAQHGHLKEKAA

SEQ ID NO: 7465 - protein, 28 aa, Artificial Sequence
  Computer-generated peptide variant
LLRMMRKYLRRLPKERAHMFRMEKLPAQ

SEQ ID NO: 7466 - protein, 51 aa, Artificial Sequence
  Computer-generated peptide variant
FWKMWKRFLRWFKRAAALAKKKANAAAHGFMLKAACLIRLHRFRKLRQMME

SEQ ID NO: 7467 - protein, 60 aa, Artificial Sequence
  Computer-generated peptide variant
RFKILRKLLRKWKPKWKAPAGTAAFIDAFAGAHKDLCRARSMIQHKAIIKARIGRLLAHD

SEQ ID NO: 7468 - protein, 32 aa, Artificial Sequence
  Computer-generated peptide variant
KYRFLQRMFRRMCKAFKAILKKFAKQAKLLGI

SEQ ID NO: 7469 - protein, 68 aa, Artificial Sequence
  Computer-generated peptide variant
LIRYFTRYYRKLKTKHYLRIRARALFAPPKVKNRCMKKQMCLYARLGRMQALLWALLRRRLPQYRAVF

SEQ ID NO: 7470 - protein, 56 aa, Artificial Sequence
  Computer-generated peptide variant
RLKLMHKLMKKLRRLKRLILPQLRVTLLLFYRCLKHKRRTLLPRNRLHRAFNQMPA

SEQ ID NO: 7471 - protein, 71 aa, Artificial Sequence
  Computer-generated peptide variant
KMRLYRRIWKKMQSKALLWVWNAWRVKVTAVPALRKAGQKKRKKKRAHMALLEHCALLRDKSLMTCRLKQS

SEQ ID NO: 7472 - protein, 29 aa, Artificial Sequence
  Computer-generated peptide variant
RLRLLKRFLKRFNRAQFGAWTNATARFGA

SEQ ID NO: 7473 - protein, 74 aa, Artificial Sequence
  Computer-generated peptide variant
RWKWLSRFMKYIKCLKLHGAQYKWGASAYKLLLKKAWAPQYRQLKIACRGVARRIKMLRMRLLLAGYRLERYRP

SEQ ID NO: 7474 - protein, 45 aa, Artificial Sequence
  Computer-generated peptide variant
RFKLFKRFLRWLKKRLSLKRKKIMLPTLHRDHLVLHKYNLVSDLF

SEQ ID NO: 7475 - protein, 77 aa, Artificial Sequence
  Computer-generated peptide variant
RWKWYKKLLRKLKPCLLCTNARSRDRRRIDARKLCRRILKLCATLVKLDQKRWNIYHLANPKPKLARAWKLFFAAMA

SEQ ID NO: 7476 - protein, 24 aa, Artificial Sequence
  Computer-generated peptide variant
LFKMLNKFMRKLRPARAKIRLILR

SEQ ID NO: 7477 - protein, 32 aa, Artificial Sequence
  Computer-generated peptide variant
RFKLFHKLLKFMSRRHEVKLYRKLDEAQAIAR

SEQ ID NO: 7478 - protein, 47 aa, Artificial Sequence
  Computer-generated peptide variant
KIRWYKRFLRYFKKRLAAALQYRDKSPDILDFRSAKVRAALQGKSLQ

SEQ ID NO: 7479 - protein, 96 aa, Artificial Sequence
  Computer-generated peptide variant
RYRLYNRLIRRIKKQHNKADKTNGLAGWRPKFLRSKFAIAARLVIDLAAGKWRLCITERKSWLFKASMLRKAKTLLRVRHKRRPRVLKTKKMQYAG

SEQ ID NO: 7480 - protein, 53 aa, Artificial Sequence
  Computer-generated peptide variant
LLRLYRKFFKMMRCHKAKAWSLQLTDCQYANRRAHQRACEKLQGKLKKLRFRA

SEQ ID NO: 7481 - protein, 24 aa, Artificial Sequence
  Computer-generated peptide variant
MLRLLNKILRRIKCRGAIQLRQNK

SEQ ID NO: 7482 - protein, 27 aa, Artificial Sequence
  Computer-generated peptide variant
FLRWIPRLFRRLRKADDQLFMYARMAL

SEQ ID NO: 7483 - protein, 61 aa, Artificial Sequence
  Computer-generated peptide variant
WFKMLHRLLRKIRKKLACLFALGRMPQLRLARTWATDFHVDAAIPKRKAYRLVWEKLKETL

SEQ ID NO: 7484 - protein, 34 aa, Artificial Sequence
  Computer-generated peptide variant
RMRILTRFFKKLRKLLRLKGGHLCPLRAWDVDVL

SEQ ID NO: 7485 - protein, 60 aa, Artificial Sequence
  Computer-generated peptide variant
LLKLLQRYMRKWCQYRLCFSKVAACAIRLLMFRKANKLTVKHCKILHLWELLRLKQERRM

SEQ ID NO: 7486 - protein, 22 aa, Artificial Sequence
  Computer-generated peptide variant
LFRLLKKYFKRYRPARWLTVEA

SEQ ID NO: 7487 - protein, 25 aa, Artificial Sequence
  Computer-generated peptide variant
RLKWLHRLFKKLTTWPLKRLCHLNK

SEQ ID NO: 7488 - protein, 20 aa, Artificial Sequence
  Computer-generated peptide variant
LIRWLPRWLRYWRKRSLAYW

SEQ ID NO: 7489 - protein, 32 aa, Artificial Sequence
  Computer-generated peptide variant
KLRFLPRFIKKMRRMQLGREAKFRMLAKLLFV

SEQ ID NO: 7490 - protein, 58 aa, Artificial Sequence
  Computer-generated peptide variant
RYKLYKKLLRLLRSEDLLEILQKHTKLGKKARGAVANIPRTPKRAVKQHHKLLWAINA

SEQ ID NO: 7491 - protein, 98 aa, Artificial Sequence
  Computer-generated peptide variant
RFRFISRLWKWIKRLANWLLKGGPAVRWLKVATMVMRAETFMAAHLLKKRHLKLQKRKYLALYNKSKKVEADMRCIVKRRTTKRAAAALGAAAIRLKK

SEQ ID NO: 7492 - protein, 76 aa, Artificial Sequence
  Computer-generated peptide variant
LFRWYRRFYKFLRNLLRRLLHFQTRCLALKRNATMIRPLLNARKALARLILQNIGFREQRLRPAYKTCEIELKSKA

SEQ ID NO: 7493 - protein, 49 aa, Artificial Sequence
  Computer-generated peptide variant
FLRFFPKLMKRLHNHGKALAFALNRYKCKLLPRHKALDLVKKARRHKWG

SEQ ID NO: 7494 - protein, 71 aa, Artificial Sequence
  Computer-generated peptide variant
RIRFFKRLFKWFKCLAKRYNYKRYTGIICHTMLLKAKADKLANTLCWRKAKLRKARNGPPLAVRHKKALKD

SEQ ID NO: 7495 - protein, 44 aa, Artificial Sequence
  Computer-generated peptide variant
MLRLYKRMLKLLKRENKYKYARARKADATWARKTTDCERTLPRS

SEQ ID NO: 7496 - protein, 30 aa, Artificial Sequence
  Computer-generated peptide variant
LYRYLKKLLRLIKCCKRLKMNMFIERVSKL

SEQ ID NO: 7497 - protein, 24 aa, Artificial Sequence
  Computer-generated peptide variant
LLKMYTKYLKKYKQHKAAKVAHKD

SEQ ID NO: 7498 - protein, 24 aa, Artificial Sequence
  Computer-generated peptide variant
LLRLLKRLLKKLSRMDMAGKHRLN

SEQ ID NO: 7499 - protein, 65 aa, Artificial Sequence
  Computer-generated peptide variant
KLRLLQKMLKYFKKLGKLVANLSLYTRHRDIQCLLRMKHVLRRAVVRDGPKSQRKAKCCKFAALD

SEQ ID NO: 7500 - protein, 64 aa, Artificial Sequence
  Computer-generated peptide variant
KIRFFTRLLRRFRTILPGKLVLAYLAIMKCRAGEKLALSLLLRIDSFARDRAAECARRMLKAFL

SEQ ID NO: 7501 - protein, 48 aa, Artificial Sequence
  Computer-generated peptide variant
MYRFFKRLLKMITCRAAMLRRGLIMGLSTTRRLDLVGKRFRLKAKRRL

SEQ ID NO: 7502 - protein, 22 aa, Artificial Sequence
  Computer-generated peptide variant
KLRYFPKIFKKYKHAAAHWLAK

SEQ ID NO: 7503 - protein, 33 aa, Artificial Sequence
  Computer-generated peptide variant
MLKMLSKWLRRLSKRRCQKAKVPKSTANKLALQ

SEQ ID NO: 7504 - protein, 30 aa, Artificial Sequence
  Computer-generated peptide variant
RIKLFPKWLKLMKKHMLACLMGRKRLLIKF

SEQ ID NO: 7505 - protein, 20 aa, Artificial Sequence
  Computer-generated peptide variant
LLKLLTRIFKRIRKRAADFL

SEQ ID NO: 7506 - protein, 22 aa, Artificial Sequence
  Computer-generated peptide variant
ILKFFRKLIRRLSRARATLSTW

SEQ ID NO: 7507 - protein, 27 aa, Artificial Sequence
  Computer-generated peptide variant
KMRFISKLFKRLNTRLKVKAQAALAKL

SEQ ID NO: 7508 - protein, 41 aa, Artificial Sequence
  Computer-generated peptide variant
FLRLFKRLLRLLNTGIKLTPLRTGLLRAWPLCDKMAAMRYK

SEQ ID NO: 7509 - protein, 65 aa, Artificial Sequence
  Computer-generated peptide variant
RLRLYKKLIRFIPSTIACVKRKQRLRAAQALPPLKLRSRRHYLVNKLCMHKKDERAKKLPFCANE

SEQ ID NO: 7510 - protein, 32 aa, Artificial Sequence
  Computer-generated peptide variant
RMKLYNKWFKKWRRKWRISVKYLAGAAAAQLW

SEQ ID NO: 7511 - protein, 45 aa, Artificial Sequence
  Computer-generated peptide variant
YLRIMPRLLRKLKKGDTISLTKKRLRADNSRLRCCAHAHLGLRFE

SEQ ID NO: 7512 - protein, 30 aa, Artificial Sequence
  Computer-generated peptide variant
KWRIMTKWLKRLKNERILLAVDLAAKRIEH

SEQ ID NO: 7513 - protein, 28 aa, Artificial Sequence
  Computer-generated peptide variant
ILKILKKLFKKLKRQRMAYNRLAPRSLM

SEQ ID NO: 7514 - protein, 25 aa, Artificial Sequence
  Computer-generated peptide variant
LFKLFRKYLKFLRRRKPVAACKAAN

SEQ ID NO: 7515 - protein, 74 aa, Artificial Sequence
  Computer-generated peptide variant
LFKLWRRLMRKLSTAKVIASAAKAMKVLAKWICRKLHRLKDWKKNCKDYKPDILCRNKCSKYKIKHKWAAKPCA

SEQ ID NO: 7516 - protein, 30 aa, Artificial Sequence
  Computer-generated peptide variant
RLRILTKFFKRLKCGLKAQFASMTPFAALA

SEQ ID NO: 7517 - protein, 73 aa, Artificial Sequence
  Computer-generated peptide variant
LMKLLRRLMRKLKKDKAAAMLAKKRCAIRKVKKKRCAKPFMCLNLKQQRMKRAEIEAFKECKRACASASRAMS

SEQ ID NO: 7518 - protein, 27 aa, Artificial Sequence
  Computer-generated peptide variant
RLRLFCKWFRILNKAFQRKEAKAAFCY

SEQ ID NO: 7519 - protein, 78 aa, Artificial Sequence
  Computer-generated peptide variant
RLRFMNKFFRKLRRTCNLLMLSCLPAQTEERKDLTAGLLLKHTRMKRFAKNRLLPHDKLGRRKHKLSQLLLPAPCLKH

SEQ ID NO: 7520 - protein, 22 aa, Artificial Sequence
  Computer-generated peptide variant
LIRLYKRFWRFLNRAKIHSLRA

SEQ ID NO: 7521 - protein, 20 aa, Artificial Sequence
  Computer-generated peptide variant
KWRIIQRFYKRLRKLLNLQA

SEQ ID NO: 7522 - protein, 38 aa, Artificial Sequence
  Computer-generated peptide variant
LLRYLRRLLRKIKSRRMRAARYGQDFISMILQLLFKAF

SEQ ID NO: 7523 - protein, 98 aa, Artificial Sequence
  Computer-generated peptide variant
KWKWLRKLLRFMQCIKAKYWLMYNAKTHLAQPGEKAAWAKKLAPQMAINDLTKLHALPGLCKRMSDKERANMASRIKVSKLKLKERCRQKKFKRLRAA

SEQ ID NO: 7524 - protein, 36 aa, Artificial Sequence
  Computer-generated peptide variant
KFRILKKIMKRFKRAGELLAHALLKKSWETLALQIW

SEQ ID NO: 7525 - protein, 25 aa, Artificial Sequence
  Computer-generated peptide variant
LLKYFKRMLRRLQCVLFKKVLLDAR

SEQ ID NO: 7526 - protein, 37 aa, Artificial Sequence
  Computer-generated peptide variant
RLRLYRRLLRRYQKAWINIILRLAPYLCAEARQNMKG

SEQ ID NO: 7527 - protein, 66 aa, Artificial Sequence
  Computer-generated peptide variant
RWRLISRLLRRLKRKDAMRKKWAKRMASMILRGSLPPTLFCSTKPARGLKNKAWAGRTLAEKRDRM

SEQ ID NO: 7528 - protein, 97 aa, Artificial Sequence
  Computer-generated peptide variant
RWRYWRKLYKRFPTDLDAPRPHLKALCALLTWHRWFGNCVARYLYLYLKLTEADVLRPEAAKKLRARRCMLRKMIWRRAPGAWKKGRALYRMKWRLR

SEQ ID NO: 7529 - protein, 23 aa, Artificial Sequence
  Computer-generated peptide variant
YFRLFRRIFRRLSSRALRVRGAL

SEQ ID NO: 7530 - protein, 50 aa, Artificial Sequence
  Computer-generated peptide variant
IFRLMKKILKKLRRVQPDALKSHCAVYAYKAAHAADRARLPTGARRFLAW

SEQ ID NO: 7531 - protein, 33 aa, Artificial Sequence
  Computer-generated peptide variant
LFRLMQRIFKKLRRLKLDSFKTALKAYRGESKT

SEQ ID NO: 7532 - protein, 29 aa, Artificial Sequence
  Computer-generated peptide variant
RWRLLPKIFKRLKRYVQLLARPLEALRAG

SEQ ID NO: 7533 - protein, 31 aa, Artificial Sequence
  Computer-generated peptide variant
WLKFFKKWMRLMRKAAILKQALLARQTVKRT

SEQ ID NO: 7534 - protein, 43 aa, Artificial Sequence
  Computer-generated peptide variant
RLKLLKKWFRFMQKLSLAKLALQNIQFYCMAQERNRMKARREA

SEQ ID NO: 7535 - protein, 32 aa, Artificial Sequence
  Computer-generated peptide variant
YIRFYRRFMKLLHKQDSARALRTKFCKSAAAK

SEQ ID NO: 7536 - protein, 64 aa, Artificial Sequence
  Computer-generated peptide variant
LFRIWHRYFKWLRTGYIARCQRNLAVRVAADFKAKLRWWALIGRRNLRAKAKRRWRHMHKVRRL

SEQ ID NO: 7537 - protein, 65 aa, Artificial Sequence
  Computer-generated peptide variant
LFKMIKRLYRKMHSALAAHLRVLKKAGGLKLKKRGKRNAAPLSDFRTPKMAYWILYKHIKYKRWN

SEQ ID NO: 7538 - protein, 42 aa, Artificial Sequence
  Computer-generated peptide variant
RLKLWRRMLKLYHRRKAALRPVERKLTRRPRFWPSLKWAALC

SEQ ID NO: 7539 - protein, 36 aa, Artificial Sequence
  Computer-generated peptide variant
KLRLLKRYMKYYNKTIIRSALWFLLRSKLLGARKKD

SEQ ID NO: 7540 - protein, 45 aa, Artificial Sequence
  Computer-generated peptide variant
LWRLIRRYYKRLTKQHLLTKRKTKKGASAHLIKRKEGWAEHAVTL

SEQ ID NO: 7541 - protein, 40 aa, Artificial Sequence
  Computer-generated peptide variant
KLRYMKKYFRIWKRCCKAKLDQWLSERLQLRALAKALWLL

SEQ ID NO: 7542 - protein, 35 aa, Artificial Sequence
  Computer-generated peptide variant
ILRLLKRLFKRMRKGIKRELALPRDMMILTPKTAY

SEQ ID NO: 7543 - protein, 37 aa, Artificial Sequence
  Computer-generated peptide variant
RLKLMRRYLRLLKREIMLGRSPAIAPVRAKRTLNDYA

SEQ ID NO: 7544 - protein, 31 aa, Artificial Sequence
  Computer-generated peptide variant
MFKFLPKFLKKLHKIAALADRRLLRALDKRA

SEQ ID NO: 7545 - protein, 78 aa, Artificial Sequence
  Computer-generated peptide variant
RLRWLKKWWKKIHKLKQYYRLLKLPAALHCAHLHKAKQQKTNAFWWPLGQGLKVLRGRTRLNMVANRGLLWLPRAPAR

SEQ ID NO: 7546 - protein, 35 aa, Artificial Sequence
  Computer-generated peptide variant
KFKLYPKIFKKFKKFACKLLSAASAFASRLGRCAW

SEQ ID NO: 7547 - protein, 72 aa, Artificial Sequence
  Computer-generated peptide variant
FLKYLRKLFRFIRRKKREGMCACQLKAGRYALRLFALRGALAMEKVRPGKKLREWKVAKRSPHLAGMKVLFR

SEQ ID NO: 7548 - protein, 36 aa, Artificial Sequence
  Computer-generated peptide variant
RLRMWTRWIKFFNRAILGLLALLALTRRTCRFAIYR

SEQ ID NO: 7549 - protein, 24 aa, Artificial Sequence
  Computer-generated peptide variant
LLRMLRRLFKILHRHARKYILISR

SEQ ID NO: 7550 - protein, 32 aa, Artificial Sequence
  Computer-generated peptide variant
LLKFYTRLMKILCRNRLANTLFRALSKALIKR

SEQ ID NO: 7551 - protein, 35 aa, Artificial Sequence
  Computer-generated peptide variant
LYKFFTKMLRFLRKLLAIKPAKKDARLAKSRFYSY

SEQ ID NO: 7552 - protein, 25 aa, Artificial Sequence
  Computer-generated peptide variant
LMRLLPKFWKKMRKQLELAKRHLKW

SEQ ID NO: 7553 - protein, 24 aa, Artificial Sequence
  Computer-generated peptide variant
RYKLLCRFFRRFRHTAMAEMALKK

SEQ ID NO: 7554 - protein, 33 aa, Artificial Sequence
  Computer-generated peptide variant
WYRLLNKLYRKLRRMVTAKKLADDDPANQAANK

SEQ ID NO: 7555 - protein, 91 aa, Artificial Sequence
  Computer-generated peptide variant
RFKYFKKLIKKLRKRKAHFADRDAECMALALLKKACQDAIRNRTAKSRLLRVRKVAARSSARRQPCACKPDADALKTKKNECEVQAWYPLG

SEQ ID NO: 7556 - protein, 53 aa, Artificial Sequence
  Computer-generated peptide variant
RLKLMKKFFRKLPKLKKFDEPADHMGLAAALEHVLRRYRKLLGGAKAAGCKQP

SEQ ID NO: 7557 - protein, 20 aa, Artificial Sequence
  Computer-generated peptide variant
RIRLMKKLFRLLTPAHPMML

SEQ ID NO: 7558 - protein, 20 aa, Artificial Sequence
  Computer-generated peptide variant
FFKLWKRLLRWFRKGHAAES

SEQ ID NO: 7559 - protein, 30 aa, Artificial Sequence
  Computer-generated peptide variant
RMRLLCKFWRKIHKKSKWLVHERLALIARW

SEQ ID NO: 7560 - protein, 56 aa, Artificial Sequence
  Computer-generated peptide variant
RWKLFKKFLKIWRQRHKAARLQRDNHNLSRLRKQMKLALKMAVYKQLELETLREAK

SEQ ID NO: 7561 - protein, 21 aa, Artificial Sequence
  Computer-generated peptide variant
RYKFIKKFMRLMHRKALDAML

SEQ ID NO: 7562 - protein, 37 aa, Artificial Sequence
  Computer-generated peptide variant
KMRFLCKLFKLYKNKRKNKLALAAALWSDLSSFRKAT

SEQ ID NO: 7563 - protein, 22 aa, Artificial Sequence
  Computer-generated peptide variant
RFRLYKKLLRRFRPLHIAQLRE

SEQ ID NO: 7564 - protein, 54 aa, Artificial Sequence
  Computer-generated peptide variant
WIKILRKLLRRWNCLKINDELKWALPRRAQLIIRQVKIAGKILLGRKRIAVDKK

SEQ ID NO: 7565 - protein, 39 aa, Artificial Sequence
  Computer-generated peptide variant
RLRIIQRILKKITHALVKIRPLLKLNSKRAEWKMAVADL

SEQ ID NO: 7566 - protein, 42 aa, Artificial Sequence
  Computer-generated peptide variant
KFRLLSKLFRRLKRIKSILCECILDNAFLKLNEAKIKKLRHA

SEQ ID NO: 7567 - protein, 88 aa, Artificial Sequence
  Computer-generated peptide variant
KLRMLHKFLRRLRKSYGAMLRCAHLKEKFKACTAKLAKKQRALIDFGKRLFKLRRAEKLAYSSHFTPRCNKARLALNLIPEARNLAFT

SEQ ID NO: 7568 - protein, 23 aa, Artificial Sequence
  Computer-generated peptide variant
LFKFLHRFLRYWRNRVIAARRAP

SEQ ID NO: 7569 - protein, 54 aa, Artificial Sequence
  Computer-generated peptide variant
LMKFLCRLLKKLHRPCNAKFPRKQKRLACECLRFAPEAQLKLAGRRYKGHLLAH

SEQ ID NO: 7570 - protein, 32 aa, Artificial Sequence
  Computer-generated peptide variant
RFKYMRRLIKRLRKAVLFCHALMCKASDSARA

SEQ ID NO: 7571 - protein, 52 aa, Artificial Sequence
  Computer-generated peptide variant
YLRILKKLLKYYRKESTLYLTKKLKPNINALADRRSLARALCNRKSQLMRRW

SEQ ID NO: 7572 - protein, 54 aa, Artificial Sequence
  Computer-generated peptide variant
RMKILRKMLKMLKHAARPPLLKLRAMSACRAFLAHMMQCFRRLAVQRGLWFRKA

SEQ ID NO: 7573 - protein, 69 aa, Artificial Sequence
  Computer-generated peptide variant
KIRMFKKILRMLQRAERLLKKRAVKAEKQARKYVHIKRKYEATSFAVKTWMKLLHTPKLLVLSFKPAGR

SEQ ID NO: 7574 - protein, 48 aa, Artificial Sequence
  Computer-generated peptide variant
RLKFWQRYMKKISKLILLLTARPIKLKHKKSYASALDDLCAAKLNAHA

SEQ ID NO: 7575 - protein, 58 aa, Artificial Sequence
  Computer-generated peptide variant
RIRWMRKYFRLLKKDAPLRQGGLTLLRNCKPWVAALKKSNTIQLRRNAGKTKRANARA

SEQ ID NO: 7576 - protein, 31 aa, Artificial Sequence
  Computer-generated peptide variant
YMKFFKKLLRLFKHRTDAGAARKEKAATAKL

SEQ ID NO: 7577 - protein, 23 aa, Artificial Sequence
  Computer-generated peptide variant
WLRWISRLWKRYRNLLPAAIAQK

SEQ ID NO: 7578 - protein, 70 aa, Artificial Sequence
  Computer-generated peptide variant
LYRILKRLFRFLRTNLAWKYQQAICKCCTLAALKLKKLRRLEAHHRLKIKHKCDRGLLDKAGGPRALCLW

SEQ ID NO: 7579 - protein, 58 aa, Artificial Sequence
  Computer-generated peptide variant
KWKFIKRWFKKMRNKYAFLSLAKRLRKLTRLSHLALICITAEKRSALELLGWKFWKLF

SEQ ID NO: 7580 - protein, 42 aa, Artificial Sequence
  Computer-generated peptide variant
KFKLMKRMMKLMRRALKKKKRFHDAMLMENLTAWLLWNISAL

SEQ ID NO: 7581 - protein, 80 aa, Artificial Sequence
  Computer-generated peptide variant
KIRYLKRLWRRMKQVLLAGKIAKSKKAKKRKWIWAKFQKVASLTLRRMEMGIDEAGKAFGGARWAFCLSFRLKKSKEAAC

SEQ ID NO: 7582 - protein, 45 aa, Artificial Sequence
  Computer-generated peptide variant
LFRWLCKLWRRMKRLRGVKGLHLPAARNNYALKTLRECNALFWAA

SEQ ID NO: 7583 - protein, 58 aa, Artificial Sequence
  Computer-generated peptide variant
KLRLMRRFIRKLRRKICASKPLPLLLALLKFGSKASKCTAWALLLYQKYHRLQNLLRD

SEQ ID NO: 7584 - protein, 32 aa, Artificial Sequence
  Computer-generated peptide variant
KFRIMPRLLKLWRRIALSANKAEDAASLQRDL

SEQ ID NO: 7585 - protein, 69 aa, Artificial Sequence
  Computer-generated peptide variant
KLKLWKKFFKRITKCRRPLLTPSFKEERLRLLPMQKAAASEEAMTHRKRAALKTHAMKKAHFALCFKWV

SEQ ID NO: 7586 - protein, 34 aa, Artificial Sequence
  Computer-generated peptide variant
KMRLINKYFKRLSHALLHRRADAAILLRWISKRM

SEQ ID NO: 7587 - protein, 33 aa, Artificial Sequence
  Computer-generated peptide variant
IYRLFKRLWRRLSPCAAIALEARGAWAKTDSRK

SEQ ID NO: 7588 - protein, 49 aa, Artificial Sequence
  Computer-generated peptide variant
RLKLLRKLLKFLHKAAARHRKLIAIQKAGKYWIRAFYAYWTLCCINPRA

SEQ ID NO: 7589 - protein, 45 aa, Artificial Sequence
  Computer-generated peptide variant
RMKLFPKWLRLFKRQPFKAKLLRAALACELRPDRTHYLKHKKALV

SEQ ID NO: 7590 - protein, 33 aa, Artificial Sequence
  Computer-generated peptide variant
WWRFWRRLFRRYCRRPRLLLAIARFLLLSNLNL

SEQ ID NO: 7591 - protein, 28 aa, Artificial Sequence
  Computer-generated peptide variant
KLKMLRKWLRRIRQNAKQLAQARPAAQL

SEQ ID NO: 7592 - protein, 64 aa, Artificial Sequence
  Computer-generated peptide variant
YFRLYKKLWRWMRRKMKNTWCALRDELEWKGLKGLARHALAARSSKRKPRAPEANKRDWLCKAS

SEQ ID NO: 7593 - protein, 33 aa, Artificial Sequence
  Computer-generated peptide variant
KFRMIRKLIKRWHKRDELKLNRALALMGCPLQA

SEQ ID NO: 7594 - protein, 57 aa, Artificial Sequence
  Computer-generated peptide variant
KLRLYQRLIKLLNKMYKLKHRKHLALELPHAATKCAPNAEIPLCPKFAKRLWGKLDD

SEQ ID NO: 7595 - protein, 27 aa, Artificial Sequence
  Computer-generated peptide variant
WWKLLKRIFKKWSKGMSAYRLAVALQL

SEQ ID NO: 7596 - protein, 56 aa, Artificial Sequence
  Computer-generated peptide variant
RLKLLRKMLRRMCSWNVEHARYKVTRHHRAFLACYKMKRVIEKLASLILPARKART

SEQ ID NO: 7597 - protein, 21 aa, Artificial Sequence
  Computer-generated peptide variant
RYRFWRKYLKYLRKLCDWLTA

SEQ ID NO: 7598 - protein, 33 aa, Artificial Sequence
  Computer-generated peptide variant
LWKFMPRFLRMLCKRQRDAADCLLRAPYALRGK

SEQ ID NO: 7599 - protein, 90 aa, Artificial Sequence
  Computer-generated peptide variant
KFKYLNRILKKFKKALTPALQSRKYTRIRSKARRAMTFRACPLVREASDTARRLLHAKPFSLLINVPDRTRRKRRATAYYHLVLLPKRAA

SEQ ID NO: 7600 - protein, 40 aa, Artificial Sequence
  Computer-generated peptide variant
MFRYFHKMLRKYKKKKERALFHMALTCRKAPNLNLNLRRD

SEQ ID NO: 7601 - protein, 54 aa, Artificial Sequence
  Computer-generated peptide variant
KIRWIRRMWKRYQKIPLVCKRLQEALSKKLQSRRSKALFRHRKAAAQYALHPLR

SEQ ID NO: 7602 - protein, 24 aa, Artificial Sequence
  Computer-generated peptide variant
FMRLFRKYFRLLHTNAKLRATLHK

SEQ ID NO: 7603 - protein, 41 aa, Artificial Sequence
  Computer-generated peptide variant
WIKLLKKWIKKLRHRRRSKLQMTLDQCFKLLLKNRYAWMFA

SEQ ID NO: 7604 - protein, 40 aa, Artificial Sequence
  Computer-generated peptide variant
KFKMLKRLYRLWRQWKRDMNNAMTGIQALRRTKRDALLRF

SEQ ID NO: 7605 - protein, 64 aa, Artificial Sequence
  Computer-generated peptide variant
RLRLFRKFMKKLKRKDARYSGRLQALHAALCFRALVNFTWTRMAKLYKDLLPALPFHELLGLWY

SEQ ID NO: 7606 - protein, 24 aa, Artificial Sequence
  Computer-generated peptide variant
WFKLWSRFIKRFQSALQKRAAKLA

SEQ ID NO: 7607 - protein, 33 aa, Artificial Sequence
  Computer-generated peptide variant
KWKLICKLYRKLNCAKRAFACASSKSDRLYRKH

SEQ ID NO: 7608 - protein, 20 aa, Artificial Sequence
  Computer-generated peptide variant
LYRYLKRLYRKLCNACLHAK

SEQ ID NO: 7609 - protein, 46 aa, Artificial Sequence
  Computer-generated peptide variant
RYRYIRKFLRIFHSVTRAVYLLTKKLRMKLALLVLAKAIRVHALKV

SEQ ID NO: 7610 - protein, 30 aa, Artificial Sequence
  Computer-generated peptide variant
RWKWWRRYLKRFRTLDKQADTWVKARLVAA

SEQ ID NO: 7611 - protein, 38 aa, Artificial Sequence
  Computer-generated peptide variant
RYRLFRRLLRRLNNAKISLAFQLVKKWLHHINYMALLR

SEQ ID NO: 7612 - protein, 20 aa, Artificial Sequence
  Computer-generated peptide variant
RLKLLRRLMRKWNNLLSLRV

SEQ ID NO: 7613 - protein, 90 aa, Artificial Sequence
  Computer-generated peptide variant
KLRLLKRYMKYLKSACKKTYKARRNLWYRLKRLRKKALHDFAKLKYCKKKERLCLKMGHEAQCKAYAAYKALGTYRKSREKMGTHKVPGA

SEQ ID NO: 7614 - protein, 77 aa, Artificial Sequence
  Computer-generated peptide variant
LMRFLQKFIKKLKQQSTGLRHVLRKRKLRTRNLTYRSHAAHRNQSLNLAAAARLHGNKREHGTKKARTKALWDKKRL

SEQ ID NO: 7615 - protein, 60 aa, Artificial Sequence
  Computer-generated peptide variant
FLRMLNRFLRLFKPTRRAKTCERLKKRVKMRLFYLAYRITMEAPALIKAPVEWLLRKKCI

SEQ ID NO: 7616 - protein, 56 aa, Artificial Sequence
  Computer-generated peptide variant
LIRLLKKLFRRFNRALIIFAKLAAGVKALKLFKVQAKLWACKNPSYKMPQYMRWHL

SEQ ID NO: 7617 - protein, 38 aa, Artificial Sequence
  Computer-generated peptide variant
KLKLFKKLFRKLRQRALAASGDAISKYCAFNFHHKVAI

SEQ ID NO: 7618 - protein, 35 aa, Artificial Sequence
  Computer-generated peptide variant
RLKLLKRYLRLLHRYQNMFIIVWLLKLRKYKKLKK

SEQ ID NO: 7619 - protein, 40 aa, Artificial Sequence
  Computer-generated peptide variant
RYKLFRKWIKRLSQDRSLALRIYAHRTRMLLILLAAIKLL

SEQ ID NO: 7620 - protein, 36 aa, Artificial Sequence
  Computer-generated peptide variant
FFKWFRKLLKMYRTCPCWDARRAPLQKLKLLREKKL

SEQ ID NO: 7621 - protein, 53 aa, Artificial Sequence
  Computer-generated peptide variant
RIKFFKRFLRLWKKEIVRFGGELRDKDARLILVPRKYLAKDTLPLLRAARPLM

SEQ ID NO: 7622 - protein, 32 aa, Artificial Sequence
  Computer-generated peptide variant
LWRYINKYIKLLRCGLLKHGLALRVNARESAR

SEQ ID NO: 7623 - protein, 52 aa, Artificial Sequence
  Computer-generated peptide variant
KLRWLTRFYKLLTRSHKSKRCWLWLLNRLPLEDYKATAMFYKEAKFAAWRRK

SEQ ID NO: 7624 - protein, 22 aa, Artificial Sequence
  Computer-generated peptide variant
KLKLWNKILRWLCKKLAGRARR

SEQ ID NO: 7625 - protein, 68 aa, Artificial Sequence
  Computer-generated peptide variant
LYKFFCRFFRFLHRLKAAATCSYPRRRERGKLRHARLKAQGIKKKWRLRGHRTGAKYNNARWALLCLI

SEQ ID NO: 7626 - protein, 45 aa, Artificial Sequence
  Computer-generated peptide variant
KFRWLCRILKFYKRKKEPNRMARLQLQRLAYLEAPRADLIRHLKQ

SEQ ID NO: 7627 - protein, 70 aa, Artificial Sequence
  Computer-generated peptide variant
LWRYLHRIFKKWQRKRLGKKAKKAHLVGREEKMMPARFNKLCMDLLCPRAKPLLRRKARKASCLAKSPSW

SEQ ID NO: 7628 - protein, 50 aa, Artificial Sequence
  Computer-generated peptide variant
RWRLLRKMFKKLRRACRFLPKRGSVADQHLCAAIIKGRRRVALHILRRLK

SEQ ID NO: 7629 - protein, 98 aa, Artificial Sequence
  Computer-generated peptide variant
LFKILRKFYKLYKRSWAGDHQKQLNRLLQEHRLKAKALESRCTCRKVRKVKKLPRHLKLKWSLKVLLCKPPFAAQNFYVPGLAPALDRKKCRKRNLQL

SEQ ID NO: 7630 - protein, 28 aa, Artificial Sequence
  Computer-generated peptide variant
LLKIFRKFLRKLHKQLQERAKDSYAYSK

SEQ ID NO: 7631 - protein, 25 aa, Artificial Sequence
  Computer-generated peptide variant
IMKLYRRFYKLFCKKPAKAHAVNKA

SEQ ID NO: 7632 - protein, 81 aa, Artificial Sequence
  Computer-generated peptide variant
ILKMFQKILRRIKCKYWAQALDACKNLKRKPKCRQKILVYNRKLKCAANPGKALTLRAYMFERKRPLAALMLILLMTHLAW

SEQ ID NO: 7633 - protein, 52 aa, Artificial Sequence
  Computer-generated peptide variant
YYKLMKRLLRRLRKILVFCKYAEQGKRIPRLPKIGALPVRKKKLLVVIAAAR

SEQ ID NO: 7634 - protein, 24 aa, Artificial Sequence
  Computer-generated peptide variant
KYKYLRRWMKKWSRKWLLLLKMLL

SEQ ID NO: 7635 - protein, 48 aa, Artificial Sequence
  Computer-generated peptide variant
LLKYFCRLIKIMSSKKKRLIEALPFSLRAAMHFEYVKKPKIRALLLAR

SEQ ID NO: 7636 - protein, 28 aa, Artificial Sequence
  Computer-generated peptide variant
MLRLMSKLLRMMKNKTESKLLRRRFALE

SEQ ID NO: 7637 - protein, 34 aa, Artificial Sequence
  Computer-generated peptide variant
FIRLFKRWLKKFNNLAQAKHAALKIRPRATFILK

SEQ ID NO: 7638 - protein, 23 aa, Artificial Sequence
  Computer-generated peptide variant
WLKLMSRWLRRLKQRLLGEIASA

SEQ ID NO: 7639 - protein, 33 aa, Artificial Sequence
  Computer-generated peptide variant
LFRLFPRLLKMFRRSRAKRLCQKLWKNLRRLLE

SEQ ID NO: 7640 - protein, 41 aa, Artificial Sequence
  Computer-generated peptide variant
FFKYLKRILKKFKPRRALLGKRYAGHLWLHAKWYNEALWHK

SEQ ID NO: 7641 - protein, 40 aa, Artificial Sequence
  Computer-generated peptide variant
KLKLYQKWLRRWPNRYHFLAAAVIRLFKKKKQRKALDYVR

SEQ ID NO: 7642 - protein, 56 aa, Artificial Sequence
  Computer-generated peptide variant
LFRYWNRFLRKMPCAKLLVKSALKEARPYLKFRAPKIHCRWLLRKALYKRWGLWAP

SEQ ID NO: 7643 - protein, 34 aa, Artificial Sequence
  Computer-generated peptide variant
KLRFIKRWLRLLTCKKLLWPHKVAWRGKLLRNRT

SEQ ID NO: 7644 - protein, 66 aa, Artificial Sequence
  Computer-generated peptide variant
KLRMFHKLLRYLCRKAGKQCMERPLKLAKMRITCLLAKALRRLRFRCYEKACKATECTQLRQADLC

SEQ ID NO: 7645 - protein, 33 aa, Artificial Sequence
  Computer-generated peptide variant
WLKYMNRFYKKLKKTTWNMLKKLLAAWSLMALK

SEQ ID NO: 7646 - protein, 73 aa, Artificial Sequence
  Computer-generated peptide variant
FLKLLTRILKLFRKFKDGKLKDAKGFFACMRRPYWLRLRRLRNMLADKRTLNALRDFAYKFVKRVKVTGARHA

SEQ ID NO: 7647 - protein, 44 aa, Artificial Sequence
  Computer-generated peptide variant
YFRLLRKMYKKWKKESKAPKNASRLDYVARTRWALAARSAMAQN

SEQ ID NO: 7648 - protein, 26 aa, Artificial Sequence
  Computer-generated peptide variant
RLRLLCRLLKFLPSTLWKPCLKHPKA

SEQ ID NO: 7649 - protein, 25 aa, Artificial Sequence
  Computer-generated peptide variant
RFRLFKKMFRFWKHKLSCALKASIL

SEQ ID NO: 7650 - protein, 40 aa, Artificial Sequence
  Computer-generated peptide variant
LLRLLKRLWRKLTPKEAQKVCDRFHLNLNTYALKRESLKM

SEQ ID NO: 7651 - protein, 20 aa, Artificial Sequence
  Computer-generated peptide variant
IFRLLHRMLKWFRSYLKAIR

SEQ ID NO: 7652 - protein, 87 aa, Artificial Sequence
  Computer-generated peptide variant
KLRWLPKYLRWIRTHAAEELAHERACLDYKDMAPLKWRKKRDRLLNLALVAKPALSLAHWKMSLHLKDCGLRLKNQTYKTKMRFILA

SEQ ID NO: 7653 - protein, 74 aa, Artificial Sequence
  Computer-generated peptide variant
RMKLWKRFYRKYRQYAPCPKAATAWKARSARLAWAIWFAYHEAKTRERLKLETQKWRHDAKRERLRLQCKINRR

SEQ ID NO: 7654 - protein, 33 aa, Artificial Sequence
  Computer-generated peptide variant
KWKMLRKLIKLMTKMNQLWALKTFALKKLSASA

SEQ ID NO: 7655 - protein, 33 aa, Artificial Sequence
  Computer-generated peptide variant
KFRFLRKLFRKLRPFLLLFKLQNQKLNITRART

SEQ ID NO: 7656 - protein, 45 aa, Artificial Sequence
  Computer-generated peptide variant
RFKLLKRFIRRLRRDVYNCWPRNTLAKRMQLRKLAYCDNKLACHL

SEQ ID NO: 7657 - protein, 23 aa, Artificial Sequence
  Computer-generated peptide variant
KLRWIRKFFKLFRNYRRWAAYLL

SEQ ID NO: 7658 - protein, 36 aa, Artificial Sequence
  Computer-generated peptide variant
RLKLIRKFIKWLCTVLLKAPKRKRELPMKWALLLMV

SEQ ID NO: 7659 - protein, 50 aa, Artificial Sequence
  Computer-generated peptide variant
KIRWWKKWYKKLRSRLWEACKLPRIDLVKTLYLAVRMACRLLYELLRNEA

SEQ ID NO: 7660 - protein, 27 aa, Artificial Sequence
  Computer-generated peptide variant
RLKLFHRLFRLFTRLFKAILKDTHMKF

SEQ ID NO: 7661 - protein, 37 aa, Artificial Sequence
  Computer-generated peptide variant
LFRLLQRWLRRLRRQIKDLRSRYKLGLAEAMVSKPRR

SEQ ID NO: 7662 - protein, 43 aa, Artificial Sequence
  Computer-generated peptide variant
RIRMWRRMFKLIKKAMFDCAMAHRPKWTLHALIPMRALRLRAR

SEQ ID NO: 7663 - protein, 34 aa, Artificial Sequence
  Computer-generated peptide variant
KFKWFRKLMKFLPHVKAMRLSENARAAKRAHDLH

SEQ ID NO: 7664 - protein, 56 aa, Artificial Sequence
  Computer-generated peptide variant
RLRYWRKILKKLTSRADALKRAAAAERLMIEKYGRIVYTYVLAKYVRPWRLRPPRN

SEQ ID NO: 7665 - protein, 40 aa, Artificial Sequence
  Computer-generated peptide variant
RIKFIRKLLRMMRQDLLIAAKFKNAVEVKKKSYMLLLDLK

SEQ ID NO: 7666 - protein, 100 aa, Artificial Sequence
  Computer-generated peptide variant
KLKLISRLLKFLPKFELLGYWLKMTRRNLMRIKALKALRNRARPLNGFRRTLVALMPLYAKLKNAHLARGLAQAKKVRMLYKGMLDNILWHHALYLERPC

SEQ ID NO: 7667 - protein, 65 aa, Artificial Sequence
  Computer-generated peptide variant
FLRLLKKMFKRIKKALRVTSRVRGRMRALLWRKLYFKAKNHASPHRQAALQLTPDNHEEEKLANR

SEQ ID NO: 7668 - protein, 50 aa, Artificial Sequence
  Computer-generated peptide variant
RYKLLKRLMRILKKAAWQMLWIRENHKKKHQKGGSLKREALFKNQSRLDA

SEQ ID NO: 7669 - protein, 27 aa, Artificial Sequence
  Computer-generated peptide variant
LYKLMHRWLRWLKKYHNFALKARQKLL

SEQ ID NO: 7670 - protein, 34 aa, Artificial Sequence
  Computer-generated peptide variant
RIRLWPKFWKRLRRAYMANAAARHKWVTAKLCTF

SEQ ID NO: 7671 - protein, 41 aa, Artificial Sequence
  Computer-generated peptide variant
RFKLMKRFYRFWPNAAAKKKPDLYANRGARALPLHIKKKRA

SEQ ID NO: 7672 - protein, 23 aa, Artificial Sequence
  Computer-generated peptide variant
KLKFFNRFIRKLSCAAAKTMGAK

SEQ ID NO: 7673 - protein, 29 aa, Artificial Sequence
  Computer-generated peptide variant
RFKIMSKLLRFYTKLLLLMLKQIKKDSKL

SEQ ID NO: 7674 - protein, 29 aa, Artificial Sequence
  Computer-generated peptide variant
RLRMWHKLWRRLNQAIACPKKAMKRLDAQ

SEQ ID NO: 7675 - protein, 48 aa, Artificial Sequence
  Computer-generated peptide variant
WLRLLRRWIRMFRSCLAKDNNKRCQLACVNFLKDNGCRAARARKCALR

SEQ ID NO: 7676 - protein, 26 aa, Artificial Sequence
  Computer-generated peptide variant
KIKLFHRLLRKLSKRCLARGARDAKN

SEQ ID NO: 7677 - protein, 54 aa, Artificial Sequence
  Computer-generated peptide variant
KIRLLRRLLKLLNTKACREARNEAKKQNNRLKSWSHKCNAKLQRMTPRDRKLLE

SEQ ID NO: 7678 - protein, 48 aa, Artificial Sequence
  Computer-generated peptide variant
RWKFLRKFYRKYNKAALLLRLRRVAHFWRLVKLACARRKPCHLEKHAI

SEQ ID NO: 7679 - protein, 59 aa, Artificial Sequence
  Computer-generated peptide variant
RMRYWPRLWRLWPRQRNAKYAKKKSNRLKKLLIKNLALVLSRPAWLPDWWAQLVLLLIK

SEQ ID NO: 7680 - protein, 92 aa, Artificial Sequence
  Computer-generated peptide variant
LYKFFKRLFKYLRKDWPRAKLMRDALIAAKKWKAPKKKSKAYQKLACLKAKAADRGANKKLNKMARVYNLDRARWSADRKKGLRFYMDRPAE

SEQ ID NO: 7681 - protein, 27 aa, Artificial Sequence
  Computer-generated peptide variant
RLRFMNRLWRRFRHLLLARLLACNRFW

SEQ ID NO: 7682 - protein, 26 aa, Artificial Sequence
  Computer-generated peptide variant
KLRLIPKILRFFKQYKLAALRARGRK

SEQ ID NO: 7683 - protein, 37 aa, Artificial Sequence
  Computer-generated peptide variant
RIRFLRRFLRRFQKRRLWMLAWAPARLLTWKWKARAT

SEQ ID NO: 7684 - protein, 66 aa, Artificial Sequence
  Computer-generated peptide variant
RLKMFPRLIRKFRKPAWPKAYLILYLLKFLLPYAGRLIKTCYKELMRKRRLPWLRMRQQRDRLNKP

SEQ ID NO: 7685 - protein, 36 aa, Artificial Sequence
  Computer-generated peptide variant
LMRFFKKLYRKFRRALCKEKCFVKKCLPTAPLILAR

SEQ ID NO: 7686 - protein, 21 aa, Artificial Sequence
  Computer-generated peptide variant
LFRIFRKFLKKFSRSDAANLL

SEQ ID NO: 7687 - protein, 78 aa, Artificial Sequence
  Computer-generated peptide variant
RYRYLKKLLKIFPPTPAKIHKTKLKARLAGRSVRAKLLCHYLALLEAFAGRKHAKRKAMASDRLKCQKIAARNSCQVH

SEQ ID NO: 7688 - protein, 62 aa, Artificial Sequence
  Computer-generated peptide variant
RLKLLTKFFRFFKRMALLARLKKKKTAAHLTLPHQEAARKALLYFKPRRAELWMRLMRVLLR

SEQ ID NO: 7689 - protein, 21 aa, Artificial Sequence
  Computer-generated peptide variant
YLKLLHKLMRLWNKRERIIGL

SEQ ID NO: 7690 - protein, 51 aa, Artificial Sequence
  Computer-generated peptide variant
KWRYIRRWIKLMRKGVMQYAARMAREVKAALRKFLLREPLLVKRHCAILWK

SEQ ID NO: 7691 - protein, 21 aa, Artificial Sequence
  Computer-generated peptide variant
MIRLLKRLFKKFKSKNLAIAA

SEQ ID NO: 7692 - protein, 28 aa, Artificial Sequence
  Computer-generated peptide variant
LFKLYRRFFKLYRRLVISKPARISRTLA

SEQ ID NO: 7693 - protein, 23 aa, Artificial Sequence
  Computer-generated peptide variant
FLRLMKRFLRKWPNALKKKIAHC

SEQ ID NO: 7694 - protein, 79 aa, Artificial Sequence
  Computer-generated peptide variant
KLRYWRKYFKLLRRELVIKFARGRKDLLKMGYPAAKHLPDAVWFAQLTARLFKWLWQRYYNAAGILRKRKYRRALCYLW

SEQ ID NO: 7695 - protein, 23 aa, Artificial Sequence
  Computer-generated peptide variant
RLKFLRRLLKKMNNTASEGARVL

SEQ ID NO: 7696 - protein, 39 aa, Artificial Sequence
  Computer-generated peptide variant
KLRWLCKLIKWFPHLRAERFLAKVMLFRAVIRRKYKDLM

SEQ ID NO: 7697 - protein, 61 aa, Artificial Sequence
  Computer-generated peptide variant
KLRLYKRLLKKYKKVCKDKRVRLFFLRPANTYLQRARVLACTHYKNHLPANAALTWKLNWN

SEQ ID NO: 7698 - protein, 35 aa, Artificial Sequence
  Computer-generated peptide variant
MYRMYRRIYRKLKRLARIEANKLARGFLCARCLYR

SEQ ID NO: 7699 - protein, 42 aa, Artificial Sequence
  Computer-generated peptide variant
LYKFLRRLLRKMHHTRQTAYLKTPAAWALWKLVTLLRKKSPA

SEQ ID NO: 7700 - protein, 40 aa, Artificial Sequence
  Computer-generated peptide variant
KFKFLKRLYRLFKKVKGKATRAILMCKKLIILWWHMEELA

SEQ ID NO: 7701 - protein, 27 aa, Artificial Sequence
  Computer-generated peptide variant
RLRIMPKLFRLFRRTAARRLCNNLTGI

SEQ ID NO: 7702 - protein, 39 aa, Artificial Sequence
  Computer-generated peptide variant
KLKFYRKLFKYMRKSWYQAWARNAWALARGWARAQFARR

SEQ ID NO: 7703 - protein, 41 aa, Artificial Sequence
  Computer-generated peptide variant
KYKWMRKWFRYLKKIWLLKASKRNRRFPLNVAALYKNLKAL

SEQ ID NO: 7704 - protein, 20 aa, Artificial Sequence
  Computer-generated peptide variant
IYKLLPRWLKRFQQKLAACL

SEQ ID NO: 7705 - protein, 44 aa, Artificial Sequence
  Computer-generated peptide variant
KLRMIKRMLRFYKKAAQKCGATRKKAPASLLSRYAASRMHLSIK

SEQ ID NO: 7706 - protein, 66 aa, Artificial Sequence
  Computer-generated peptide variant
KIRMWTRFMKKYQKLRDASWHLRIGEAKALAARWLKKAARLEIKYADETAFKALEKLKLHLRNVCI

SEQ ID NO: 7707 - protein, 67 aa, Artificial Sequence
  Computer-generated peptide variant
LLRMMCKFYKKFRKKTLARAGLAKLKLLNRPEKPDFVNKGRGWGLAYLLASAYALFKPIPAATAMSK

SEQ ID NO: 7708 - protein, 30 aa, Artificial Sequence
  Computer-generated peptide variant
RIRFLTKWIKLFQRKRLLAKELVAVRKKDL

SEQ ID NO: 7709 - protein, 90 aa, Artificial Sequence
  Computer-generated peptide variant
RFRLIKKFYKLLRKDKNPAKRLKKRAYRQRLQAASKCFQARPLLRLLLFKHEKKAALAIERDQCKRLALFFKDRLCARLALLLFKSRHWT

SEQ ID NO: 7710 - protein, 21 aa, Artificial Sequence
  Computer-generated peptide variant
YYKLYRKLFKKMRQKLMAPYL

SEQ ID NO: 7711 - protein, 27 aa, Artificial Sequence
  Computer-generated peptide variant
LLRYMPKMLRKLNKHIMPAGHCAARKL

SEQ ID NO: 7712 - protein, 26 aa, Artificial Sequence
  Computer-generated peptide variant
YWKLLRKIFRKLSQRQDAHKAALKHM

SEQ ID NO: 7713 - protein, 58 aa, Artificial Sequence
  Computer-generated peptide variant
KLRFFNKIYRRFQTQRRRLLDRWARLVDMKSRYRCMALQNKVSAAALRRANRAHARMV

SEQ ID NO: 7714 - protein, 22 aa, Artificial Sequence
  Computer-generated peptide variant
YWKLLSKLIRKFRKYPAKAALK

SEQ ID NO: 7715 - protein, 39 aa, Artificial Sequence
  Computer-generated peptide variant
KLRLFQRYMKLLKSLAQKWLFLLRVRLAWSAKCNRDRQR

SEQ ID NO: 7716 - protein, 23 aa, Artificial Sequence
  Computer-generated peptide variant
RWRLLKKLFKKINKALDCILETT

SEQ ID NO: 7717 - protein, 59 aa, Artificial Sequence
  Computer-generated peptide variant
KLRFLNRFFKLLCHHLPELLAEYTVRAQARKRSWWVPILLRRLRYRMRQKRARAHKKAA

SEQ ID NO: 7718 - protein, 26 aa, Artificial Sequence
  Computer-generated peptide variant
LYKLYKRMFKFFKHAGKLAKLAPQRK

SEQ ID NO: 7719 - protein, 43 aa, Artificial Sequence
  Computer-generated peptide variant
LIRLLKRLLRLWPNRVRAAKTLAMRRMGDVPLSARAMPWKIDR

SEQ ID NO: 7720 - protein, 48 aa, Artificial Sequence
  Computer-generated peptide variant
IFRFWKKLIKKWRKRCAAQWAEYARAPEGAKIKEALDKLLAWVVAYRA

SEQ ID NO: 7721 - protein, 50 aa, Artificial Sequence
  Computer-generated peptide variant
RIKLLPRLFRKLRHIRETISRRRERLAYAAAWETLLGLGNADAAKRKKKD

SEQ ID NO: 7722 - protein, 39 aa, Artificial Sequence
  Computer-generated peptide variant
KLRFFRKLLKLFKNLQKMLRDARMSKLELKLGWVKKPLQ

SEQ ID NO: 7723 - protein, 36 aa, Artificial Sequence
  Computer-generated peptide variant
LLKLIQKYFKRLKNRWRRKRLIVAKATIKLAAMGEP

SEQ ID NO: 7724 - protein, 39 aa, Artificial Sequence
  Computer-generated peptide variant
RIKLISRFLKRMKKACLLKALCAAMRANRAGHGWNLFVS

SEQ ID NO: 7725 - protein, 21 aa, Artificial Sequence
  Computer-generated peptide variant
YYKMLKRIMKLLRQGKALVPR

SEQ ID NO: 7726 - protein, 33 aa, Artificial Sequence
  Computer-generated peptide variant
FIRLYRRMWRKWKSALAWSPKKCFAKLRLLYRA

SEQ ID NO: 7727 - protein, 21 aa, Artificial Sequence
  Computer-generated peptide variant
RLRYFRRYYKRYTNKGLIAAA

SEQ ID NO: 7728 - protein, 52 aa, Artificial Sequence
  Computer-generated peptide variant
FLKLYCKYFRRLKREKAHIYRKAAKCACLGKAAKAMKPKQNLLLTGTKKKQK

SEQ ID NO: 7729 - protein, 54 aa, Artificial Sequence
  Computer-generated peptide variant
LLKIYRKWMRLLKPRALTKKKLCQDIPLQDRKDTLLARKRILMPARRLWILKVW

SEQ ID NO: 7730 - protein, 35 aa, Artificial Sequence
  Computer-generated peptide variant
RFKMIQRFWRRLTKGKWAALSAPLTMWKARLARMK

SEQ ID NO: 7731 - protein, 45 aa, Artificial Sequence
  Computer-generated peptide variant
LIKWYKKMMKKLTRKLKDFAKLTVMYAAPQCRHYLLWSKRRLLKR

SEQ ID NO: 7732 - protein, 21 aa, Artificial Sequence
  Computer-generated peptide variant
KFRLLRRIMRWFQRHLLKAAK

SEQ ID NO: 7733 - protein, 21 aa, Artificial Sequence
  Computer-generated peptide variant
RLKLYRRFIRLWCKLSHQHKA

SEQ ID NO: 7734 - protein, 74 aa, Artificial Sequence
  Computer-generated peptide variant
LLRLLRRMFKFLRKYHILIKLKKQLKNDTPSASELMAMMALKNCMLRLLSREHRVLVNAARLCRALAWFRKARR

SEQ ID NO: 7735 - protein, 29 aa, Artificial Sequence
  Computer-generated peptide variant
YFKFFRRMLRLYKREQQFLRRYLKAMGAL

SEQ ID NO: 7736 - protein, 24 aa, Artificial Sequence
  Computer-generated peptide variant
KFKILPKLLRKIKKENVYRLLACV

SEQ ID NO: 7737 - protein, 40 aa, Artificial Sequence
  Computer-generated peptide variant
YFKLLKRLYKRFRKQRALHRNLTAARLACSAWCAREIFNK

SEQ ID NO: 7738 - protein, 45 aa, Artificial Sequence
  Computer-generated peptide variant
IWKLFKRYFKRISHQANKKTKRLRLMISMKLTILTLKTAVLALLA

SEQ ID NO: 7739 - protein, 97 aa, Artificial Sequence
  Computer-generated peptide variant
RMRLLNKYFRRLRRNPAYHAACLYCKRRCKKFARRLLSKDRKRCGRRKCRLIDKAGTAAENLRKRYRRVKRLRVATLFLGHAAVLWLWVKFYWMHAL

SEQ ID NO: 7740 - protein, 47 aa, Artificial Sequence
  Computer-generated peptide variant
MMRYMTKLLRFYQRGQKSAALRQRRRRLVHYARRDALCKLFGRSKLL

SEQ ID NO: 7741 - protein, 98 aa, Artificial Sequence
  Computer-generated peptide variant
KLKILHKMFKLMPRRAYKALLGFHLRAKFHRRYKLALKRLYQAWRAVMTPKLKMELLLKLKAKRLDGYNRVLLLRKDDHIRGPLKNERAYAIRHLKYC

SEQ ID NO: 7742 - protein, 64 aa, Artificial Sequence
  Computer-generated peptide variant
WLRLMRRIMRFLNKTRWPLEKGRARKATDILKAKFGKRLPWLKKCSLINKRAALTAKVSRMLED

SEQ ID NO: 7743 - protein, 53 aa, Artificial Sequence
  Computer-generated peptide variant
LIRLMHRLLRLIKKRKAKALKKLWPCQVKRGASKAKKVIFQIRLTDRATVDSP

SEQ ID NO: 7744 - protein, 36 aa, Artificial Sequence
  Computer-generated peptide variant
KLKFFRRLMRMFSRRALKLKTNVHLSDRAPGCKCAA

SEQ ID NO: 7745 - protein, 40 aa, Artificial Sequence
  Computer-generated peptide variant
KFRLYRRLIKKFTKLIKEHRAEYKAYNKARRLKALMCALS

SEQ ID NO: 7746 - protein, 48 aa, Artificial Sequence
  Computer-generated peptide variant
IYKLLPKLMKKLPHAMLAKAGLHKRPGRMGMARNAFLEKMLNIRKRWA

SEQ ID NO: 7747 - protein, 42 aa, Artificial Sequence
  Computer-generated peptide variant
RLKLMPRFLRKIRHLWNYAETATWAMCALKCAAKLVLIKAKN

SEQ ID NO: 7748 - protein, 63 aa, Artificial Sequence
  Computer-generated peptide variant
FYRLMRKYWRRFKKSEHRRALYPWIALKAAAPWAKCKRLRLWCKIMGLRHKKANCFIAIARKQ

SEQ ID NO: 7749 - protein, 46 aa, Artificial Sequence
  Computer-generated peptide variant
MYRFWCKFYRLLRRAEWKARLRLAGRKPRACRLGRKRLTISELWQS

SEQ ID NO: 7750 - protein, 27 aa, Artificial Sequence
  Computer-generated peptide variant
RFRLWNKILKRLRKALTGFHECAAVRL

SEQ ID NO: 7751 - protein, 49 aa, Artificial Sequence
  Computer-generated peptide variant
KFRLMKRILKRLKRYMRLKARATRIEVHLAHRCTRLIVCSTCTKAEKLL

SEQ ID NO: 7752 - protein, 20 aa, Artificial Sequence
  Computer-generated peptide variant
KWRYWHKFLKFLRTNLLMLA

SEQ ID NO: 7753 - protein, 89 aa, Artificial Sequence
  Computer-generated peptide variant
RLRIIKKLWKYMPKNALAPKPLSMNLLAIPYREQAALDKRAARGERVNSKKHTQNWGAFARLHRKMKRKARVKQKYRLRCLAIHYRKKY

SEQ ID NO: 7754 - protein, 25 aa, Artificial Sequence
  Computer-generated peptide variant
RLKLLQKWLRFLRSHLATLRKPHMY

SEQ ID NO: 7755 - protein, 96 aa, Artificial Sequence
  Computer-generated peptide variant
LFRLMSRLMRMMRCIKAHKQLKYAWDRRKSAVLIIGMRTRVALALNLRKFKFYGLNLLLAYQKQLSRAARRKTYDLDMAKARAPRRIASARTICRN

SEQ ID NO: 7756 - protein, 83 aa, Artificial Sequence
  Computer-generated peptide variant
LWKLLKRYFKMMRKQGCCAALKFKSAYTCLERYKAYRYAKLRVLTKKKQLNKRGADRHAWNMVPKKLKKLNRALYPETWRYLA

SEQ ID NO: 7757 - protein, 25 aa, Artificial Sequence
  Computer-generated peptide variant
FLKLLTKWLRFLKRADRDFYIRRMQ

SEQ ID NO: 7758 - protein, 60 aa, Artificial Sequence
  Computer-generated peptide variant
FWRYLKRYLKMLNKALASLCTRKGCRLMANLDYRARLKWNAFGAPVYKLKVRAAFAKPRM

SEQ ID NO: 7759 - protein, 33 aa, Artificial Sequence
  Computer-generated peptide variant
RLRLYRKLFRKFRCVAKAAYNKFGHRMAAFCRL

SEQ ID NO: 7760 - protein, 27 aa, Artificial Sequence
  Computer-generated peptide variant
KLRIYPRMWRKFCKLLRIRALKAIANW

SEQ ID NO: 7761 - protein, 61 aa, Artificial Sequence
  Computer-generated peptide variant
LFKYIKKWLKLLKKKATIFPKRKFPMCRAKLLWLWVKLPYLYHCALRLLACRAPACRDKQR

SEQ ID NO: 7762 - protein, 31 aa, Artificial Sequence
  Computer-generated peptide variant
KLKFLKKLFRKITRALHLRAAFGYPLLPRYK

SEQ ID NO: 7763 - protein, 24 aa, Artificial Sequence
  Computer-generated peptide variant
LWKYLQRYIRMFPRARAFLSRRLA

SEQ ID NO: 7764 - protein, 66 aa, Artificial Sequence
  Computer-generated peptide variant
FLKYYKRFIKRWRKEASAKLRALRLPLDAKRHAMKRALRAKKDMRWFMALRLLAMLWAKWKNQDKG

SEQ ID NO: 7765 - protein, 66 aa, Artificial Sequence
  Computer-generated peptide variant
KYKLMTKLLRMYPKKLRTRLVARWLVLRPKSAYRKYAPRWLQVWLRSNRYDKYVLAKIMSLTLKLK

SEQ ID NO: 7766 - protein, 100 aa, Artificial Sequence
  Computer-generated peptide variant
WLRFWSKLWKRFKTCSAKKAKRDAADMKAHKARKAVHRTYAKTRRDPRAVKIKMRGLRLKFSRPDQWADAFKLDKFMLKKLARKLCKERAMYTILLMCKD

SEQ ID NO: 7767 - protein, 62 aa, Artificial Sequence
  Computer-generated peptide variant
KWKFFKRLLKRWRRIKILRKRIDLHYEHARIYAGYKIFRALIRLSCPQQAWLAALAALFLAK

SEQ ID NO: 7768 - protein, 41 aa, Artificial Sequence
  Computer-generated peptide variant
RLKWINKFFRRLSRSHDSQHVLAAFLKKKARTLIAAGRVAR

SEQ ID NO: 7769 - protein, 20 aa, Artificial Sequence
  Computer-generated peptide variant
RLRLFKRFLRIMCRAYAAVR

SEQ ID NO: 7770 - protein, 33 aa, Artificial Sequence
  Computer-generated peptide variant
FLRLYKRWIKIFRRMRLLNQLQEHRLLLRDKAL

SEQ ID NO: 7771 - protein, 41 aa, Artificial Sequence
  Computer-generated peptide variant
KFRLLKRYWKMLRKHASARAAQNTVQLNTMAALWQEKARRG

SEQ ID NO: 7772 - protein, 76 aa, Artificial Sequence
  Computer-generated peptide variant
IFRYYKKILKRLRKKKLNAKKEAKRKDLWPQIDKSRAILQNKIPLECIALNLLYDLKRENRVWLRKLKAKTEFQAG

SEQ ID NO: 7773 - protein, 25 aa, Artificial Sequence
  Computer-generated peptide variant
FMKLFKRFYKMYRKIATAAPLRRAC

SEQ ID NO: 7774 - protein, 20 aa, Artificial Sequence
  Computer-generated peptide variant
ILRFLKRLWRRLTKANAVQT

SEQ ID NO: 7775 - protein, 40 aa, Artificial Sequence
  Computer-generated peptide variant
KYKMICKLLRKLRRTVRMGRCEATYLLFAHKEDKLRFLNK

SEQ ID NO: 7776 - protein, 36 aa, Artificial Sequence
  Computer-generated peptide variant
RLKLIKKWIRKLKRYKACFACAHCLWPLKWHKDAGW

SEQ ID NO: 7777 - protein, 48 aa, Artificial Sequence
  Computer-generated peptide variant
LLRWIKKLLRFLPQAWNTMLIQCLGMHRKLRRQKSLKREKMGAQLRAR

SEQ ID NO: 7778 - protein, 38 aa, Artificial Sequence
  Computer-generated peptide variant
LLRMLKRIIRKLRRLKAEAFLKMLAYDSDALHGYLKMM

SEQ ID NO: 7779 - protein, 52 aa, Artificial Sequence
  Computer-generated peptide variant
LFKYWRKFLKILNKYKRALPLAKLKKKYRPGKAALDWLIRKNLKKLAFVAAR

SEQ ID NO: 7780 - protein, 25 aa, Artificial Sequence
  Computer-generated peptide variant
WFKIYKKIMRLIKKHIFALLRLRAE

SEQ ID NO: 7781 - protein, 43 aa, Artificial Sequence
  Computer-generated peptide variant
KLKFYKRMFRRLRNKARLAQQAFAMKPTAPGSRLRWLKMCRSW

SEQ ID NO: 7782 - protein, 23 aa, Artificial Sequence
  Computer-generated peptide variant
RLKWLPRLYKLYKQSKAARHHAK

SEQ ID NO: 7783 - protein, 25 aa, Artificial Sequence
  Computer-generated peptide variant
IFRFIRKYIRLLTHKYKLWRAERLL

SEQ ID NO: 7784 - protein, 32 aa, Artificial Sequence
  Computer-generated peptide variant
RLKYFNKILKKLNNPNHLLRAKAAVFKYARIH

SEQ ID NO: 7785 - protein, 25 aa, Artificial Sequence
  Computer-generated peptide variant
IIRLLCRLLRLFKKDYLSKNNNDAL

SEQ ID NO: 7786 - protein, 41 aa, Artificial Sequence
  Computer-generated peptide variant
ILKFLTRLLKRFKHRHVCHHLLRRRLATLVAPRRLRSKMQG

SEQ ID NO: 7787 - protein, 50 aa, Artificial Sequence
  Computer-generated peptide variant
RYKFYPRFLKYYKSARKKRDCTDYKLSLRKEADLNLYLARQQLLLKVLKK

SEQ ID NO: 7788 - protein, 32 aa, Artificial Sequence
  Computer-generated peptide variant
KLRFWQKLMRKIPKADTAYLKKEASAKRSNAI

SEQ ID NO: 7789 - protein, 58 aa, Artificial Sequence
  Computer-generated peptide variant
RYKFMKKLWKFIRRRLVDRKRAPTVAIKCLPRARTKQLACNPLGQTKDFAAASLYLRK

SEQ ID NO: 7790 - protein, 67 aa, Artificial Sequence
  Computer-generated peptide variant
RLRIWKKYFKRLQKRKLEAILFDMDAMNPTWASIALYLRGRWALAKAKKASLKMLCSRRPPGAHRNA

SEQ ID NO: 7791 - protein, 28 aa, Artificial Sequence
  Computer-generated peptide variant
IWRLWRRLLRRLRSTYAKDECKPRALTP

SEQ ID NO: 7792 - protein, 38 aa, Artificial Sequence
  Computer-generated peptide variant
WLKFLPRFYRLLQSIAPKRAKKKEAFKDQKKMLVIKAA

SEQ ID NO: 7793 - protein, 59 aa, Artificial Sequence
  Computer-generated peptide variant
WWKLFRRLFKRFKKLLAALIRMALQRKLYRHKLLRLPSFCQAVDALAKKCKSVQYLNGR

SEQ ID NO: 7794 - protein, 41 aa, Artificial Sequence
  Computer-generated peptide variant
KIKLWRRWFRRWSKRALARPWMNRKVKAAPLKQACVLACKM

SEQ ID NO: 7795 - protein, 67 aa, Artificial Sequence
  Computer-generated peptide variant
RMKMLRKIIRRLRKVRKLRLDECAWRCMWKKLHVRSDLHAYLWARPKIALDCYIRKYAKLPRRALKA

SEQ ID NO: 7796 - protein, 34 aa, Artificial Sequence
  Computer-generated peptide variant
LLKLLSKLFKYIRKKRNLHRQVFMKLYAQQRRKA

SEQ ID NO: 7797 - protein, 29 aa, Artificial Sequence
  Computer-generated peptide variant
RWRIWQRLIRKFRSLHAKLWANDRILRQA

SEQ ID NO: 7798 - protein, 33 aa, Artificial Sequence
  Computer-generated peptide variant
LLKWIRKMFKKWQPSARKAGAIQMRLFLKALRG

SEQ ID NO: 7799 - protein, 62 aa, Artificial Sequence
  Computer-generated peptide variant
KLKLFRRFFKRYRCHKGLLKIRRKDSYQTKVRLRRAHWHANQKRIWNLTSLLLRVASLVALR

SEQ ID NO: 7800 - protein, 45 aa, Artificial Sequence
  Computer-generated peptide variant
YWKLWRRLFRMLQQKPDKFIKAVFLARRYKLLKLKLCHRAVRPSE

SEQ ID NO: 7801 - protein, 64 aa, Artificial Sequence
  Computer-generated peptide variant
RYKLLKKLFRRWNRFMATKQVGHAFMRTILKNAAKKARFHAVLIQFKALRLCGKPYRNLARLKL

SEQ ID NO: 7802 - protein, 48 aa, Artificial Sequence
  Computer-generated peptide variant
KLRLFCRLYKLYKHAAERKWKQSTKSIKPELNLAHKLPLQKKAEQSRK

SEQ ID NO: 7803 - protein, 24 aa, Artificial Sequence
  Computer-generated peptide variant
MLRLLNRLYKKFHSLEKLLVRRMR

SEQ ID NO: 7804 - protein, 43 aa, Artificial Sequence
  Computer-generated peptide variant
KFRFFRKLIKYIKNRAGYAACKAKSHAKLAYAALRRQRRKEPQ

SEQ ID NO: 7805 - protein, 30 aa, Artificial Sequence
  Computer-generated peptide variant
RWKYLTRLIKYFRKCLALHSKPALRSTSKA

SEQ ID NO: 7806 - protein, 21 aa, Artificial Sequence
  Computer-generated peptide variant
LYRFLKKMLRLLKRYILNLRS

SEQ ID NO: 7807 - protein, 43 aa, Artificial Sequence
  Computer-generated peptide variant
LLRMWKRIYKKIRRALAAAKTKLIFKRLLLVQHMAYRTKANEK

SEQ ID NO: 7808 - protein, 33 aa, Artificial Sequence
  Computer-generated peptide variant
RFKILKRWWKKLSKAFRTAWLKMDVAKWAHARD

SEQ ID NO: 7809 - protein, 52 aa, Artificial Sequence
  Computer-generated peptide variant
RWRWFRRWLKILKRFWALRHLQAMYCAMYLFLKFYGKLAMAAKKTRRKETRL

SEQ ID NO: 7810 - protein, 36 aa, Artificial Sequence
  Computer-generated peptide variant
LLRWLKKFMKRYNKACLMAAALSGKCCQNQASRDRR

SEQ ID NO: 7811 - protein, 36 aa, Artificial Sequence
  Computer-generated peptide variant
RLRFYTRFFKRFKKKAQVVFKPALLDAKALALDRPE

SEQ ID NO: 7812 - protein, 43 aa, Artificial Sequence
  Computer-generated peptide variant
LIRLFKKLIKRIRRPELASAQPLRLERYLWYNTKLKRKHKCET

SEQ ID NO: 7813 - protein, 35 aa, Artificial Sequence
  Computer-generated peptide variant
WLRMLCKFLKKLPKKKALSAHAKVDWKVWRFKGTA

SEQ ID NO: 7814 - protein, 52 aa, Artificial Sequence
  Computer-generated peptide variant
FLKFIKKLLRKMRKLYRPGLKPCNKHAANLLRCDLWAIRHRKLVQKATLKKN

SEQ ID NO: 7815 - protein, 24 aa, Artificial Sequence
  Computer-generated peptide variant
WLRYLKKLYKLWNNKILLTCERLL

SEQ ID NO: 7816 - protein, 60 aa, Artificial Sequence
  Computer-generated peptide variant
MIRMFKRILRRLKQFAANLENLRAAYDELTALSRFAKLDNQGLQNGHKWLRHKFKALRKK

SEQ ID NO: 7817 - protein, 20 aa, Artificial Sequence
  Computer-generated peptide variant
RMKLLPRFLRFIKTVAALKA

SEQ ID NO: 7818 - protein, 43 aa, Artificial Sequence
  Computer-generated peptide variant
FFRLMRKLLKKFKKYGFEADAVAASCYKCREKALTRKWWLLHL

SEQ ID NO: 7819 - protein, 55 aa, Artificial Sequence
  Computer-generated peptide variant
FYKLLSKYLRMLKKHLYYWIAAQYSRALLYRKHAKLAHSLRRRNRAKDGAERLRQ

SEQ ID NO: 7820 - protein, 32 aa, Artificial Sequence
  Computer-generated peptide variant
RLKLLTKWIRLYRRYRLLKAPAVSHLARMLVV

SEQ ID NO: 7821 - protein, 69 aa, Artificial Sequence
  Computer-generated peptide variant
FFRYYRRILKKIRCTPDRDVKKILLARKKARVCGQLTRKFEHLAALRKRALEHALLRYRDKKLRNVAQV

SEQ ID NO: 7822 - protein, 20 aa, Artificial Sequence
  Computer-generated peptide variant
FFKLYRKFYKLFRHDSRLAL

SEQ ID NO: 7823 - protein, 98 aa, Artificial Sequence
  Computer-generated peptide variant
KFRILKRLFKWLNKLMLQYALCAGKMAKRKWKLTAAQALLKEKCFFCFKRGNSAEYWAALRKRGYLKLKKAMAECSCAKSMLLARCMARKTGHRIDWG

SEQ ID NO: 7824 - protein, 23 aa, Artificial Sequence
  Computer-generated peptide variant
RWRLMHRLLRKLCRKPRGALRAI

SEQ ID NO: 7825 - protein, 43 aa, Artificial Sequence
  Computer-generated peptide variant
FMRLWKRFYRLFCKFRLFKKLRAMLKAWLRTARRLRLNQMLHL

SEQ ID NO: 7826 - protein, 66 aa, Artificial Sequence
  Computer-generated peptide variant
YFRFLRKFFKKLKKARRKSCAIAQWGSTYNKKLNCIKKARRRLPKQYAATADAERLAKRELLKVAN

SEQ ID NO: 7827 - protein, 80 aa, Artificial Sequence
  Computer-generated peptide variant
KLRIWNKLWKRYTRYATKMIKEDWAARRDFKAQPIRRQAPALGRKLLRIAAAKPNNLEHFSRKSIGRAAEGKLGYLKLLL

SEQ ID NO: 7828 - protein, 32 aa, Artificial Sequence
  Computer-generated peptide variant
RYRLIKKWYRFLRRHKHVVKQLKLNLLTAAFD

SEQ ID NO: 7829 - protein, 49 aa, Artificial Sequence
  Computer-generated peptide variant
ILRWLRRIFRLFRKAAPGLNRNCIELALAAKRLNCGAARTRILHKRAHR

SEQ ID NO: 7830 - protein, 61 aa, Artificial Sequence
  Computer-generated peptide variant
KMKYLRRFFRRLHNHCPKAELAFCWYLWKKIKKKLCLAAKRAYALLARTLAECYMKTRTML

SEQ ID NO: 7831 - protein, 48 aa, Artificial Sequence
  Computer-generated peptide variant
KWRLYHRFLKRMKQGRRKCVMYALALRALLVTCYARSNLFRLLSLIYA

SEQ ID NO: 7832 - protein, 31 aa, Artificial Sequence
  Computer-generated peptide variant
RLRLFTKLMKRLRRDCINHWLKAKTNLALEI

SEQ ID NO: 7833 - protein, 45 aa, Artificial Sequence
  Computer-generated peptide variant
RLKLLRKMFRMFKKEWRADRDFYFAKKWIPWAAAPLLGKILHCAL

SEQ ID NO: 7834 - protein, 53 aa, Artificial Sequence
  Computer-generated peptide variant
MIKLLKRMFKRLKQNPRGNHKRRLLAYRAWLPHYLLQSAKPATYAKEIKKRHK

SEQ ID NO: 7835 - protein, 46 aa, Artificial Sequence
  Computer-generated peptide variant
YYKILKRFFKKMRRARCLFLLRYCAIAVAYAKRAKAAKQSDTVDSK

SEQ ID NO: 7836 - protein, 60 aa, Artificial Sequence
  Computer-generated peptide variant
KLRIFKKLFKMLRTVRNNRARFARDSVKWQAYQDFRDLRKFRKLAHVSLSKLATARLGTA

SEQ ID NO: 7837 - protein, 33 aa, Artificial Sequence
  Computer-generated peptide variant
RYKMWKKIMKKYPNLRAKSLKLWACATLAVAKT

SEQ ID NO: 7838 - protein, 66 aa, Artificial Sequence
  Computer-generated peptide variant
RLRLYNRMFRKLKKAVPDARQLIAKHLYRHLMVKARLKRLHAGLDYGRCSLKIKRDQPAINWRKKI

SEQ ID NO: 7839 - protein, 29 aa, Artificial Sequence
  Computer-generated peptide variant
RIKFWHKMWRFLSRYPKALAPCRLKKAMA

SEQ ID NO: 7840 - protein, 47 aa, Artificial Sequence
  Computer-generated peptide variant
FFRFLCRYYKRLRKLLRLPARHAARALHCLRIRKQQKRVLDKAKHTT

SEQ ID NO: 7841 - protein, 22 aa, Artificial Sequence
  Computer-generated peptide variant
YLKFLQRFYKRLTRRHAARAAA

SEQ ID NO: 7842 - protein, 75 aa, Artificial Sequence
  Computer-generated peptide variant
LFRLFNKFWRLYKSLRLKSKTAKLALRSRATYEILYLILMAKKFKKAKWTKTRHAPARHRTKKLNFKAALLRSPG

SEQ ID NO: 7843 - protein, 26 aa, Artificial Sequence
  Computer-generated peptide variant
FLRLLKKIYKKFRNLKAMLPYDAADM

SEQ ID NO: 7844 - protein, 46 aa, Artificial Sequence
  Computer-generated peptide variant
KLKWMPKWLRLLKRKRRLQSRVSAMLKRPRLFDRALVVKYEAWCCD

SEQ ID NO: 7845 - protein, 20 aa, Artificial Sequence
  Computer-generated peptide variant
KWKLLKRLLKWLSRWAGKHT

SEQ ID NO: 7846 - protein, 38 aa, Artificial Sequence
  Computer-generated peptide variant
LMRLFPRFIKKLRRAAELVRTEHLYRDYLLKRRCFHLC

SEQ ID NO: 7847 - protein, 74 aa, Artificial Sequence
  Computer-generated peptide variant
MLRLLQKMLRRMKRFMPGLVRKPETYLQYLCLTLAYKKPLKKLRKLREKRQNKKAIMRAQAHATSARPYHLAKA

SEQ ID NO: 7848 - protein, 41 aa, Artificial Sequence
  Computer-generated peptide variant
FLKFLRRLFKKYTTLKMSQWNDLFRLWDRARALLFWKRRAL

SEQ ID NO: 7849 - protein, 27 aa, Artificial Sequence
  Computer-generated peptide variant
YLRWICKFYKRLQSGDALWLRRRLALF

SEQ ID NO: 7850 - protein, 47 aa, Artificial Sequence
  Computer-generated peptide variant
RIKWLKRMMRMWRTAAHALRQLANGAADAAAKRKRRDMWTMWNDLAT

SEQ ID NO: 7851 - protein, 35 aa, Artificial Sequence
  Computer-generated peptide variant
KLRWWNRMLKFLRKALRMKNDFVLAWAKVVPRKPL

SEQ ID NO: 7852 - protein, 24 aa, Artificial Sequence
  Computer-generated peptide variant
RLRLFKKLLKLFTKIDCFKKFALQ

SEQ ID NO: 7853 - protein, 38 aa, Artificial Sequence
  Computer-generated peptide variant
FLKLYSRFLRKFSRCKKKLEAKWDMFKLAAKCGLPTHA

SEQ ID NO: 7854 - protein, 37 aa, Artificial Sequence
  Computer-generated peptide variant
FFRYFRRLWRRLCRQRKPLHLALCAYRLQRAFQNLRR

SEQ ID NO: 7855 - protein, 42 aa, Artificial Sequence
  Computer-generated peptide variant
RIKLLKKLLKFFKSGLDKLEKSHVWKLWGTNRLTDLLKNKRA

SEQ ID NO: 7856 - protein, 39 aa, Artificial Sequence
  Computer-generated peptide variant
RLRLLRRMIRWLNSRRAELRVASAEAQVKMKQAGRQPNL

SEQ ID NO: 7857 - protein, 56 aa, Artificial Sequence
  Computer-generated peptide variant
LLRLLCRLMKRMHRYTLRHAQLIYLPKRRWWRAAFKDCKVRCALASRLKHHKASSL

SEQ ID NO: 7858 - protein, 60 aa, Artificial Sequence
  Computer-generated peptide variant
MWRWFRKWYRRLNRGRRKRNAPPTFLKLEEKAEALQLARIYKKDVFWRFLLAKKLLLKAF

SEQ ID NO: 7859 - protein, 82 aa, Artificial Sequence
  Computer-generated peptide variant
LLRIWTRMLRKMRTLKRLLLARYRVTRHKNARARTHCKKAKWNVILAKARAAGEAMEKAAFVCKKRGGLKILLSPMRTFLHV

SEQ ID NO: 7860 - protein, 98 aa, Artificial Sequence
  Computer-generated peptide variant
KWKWMCRYLRRWKRIKTWQQTNAAALRLDLAPALLRRFKMLTWYADYRRNLRVLLFRAKGHFKLLGAKYKYAMQPRRAKPHLEAARHRMQQDLIRYAR

SEQ ID NO: 7861 - protein, 31 aa, Artificial Sequence
  Computer-generated peptide variant
RLKLWHKLFRFLQKFPTRRLKAALAKRTYAR

SEQ ID NO: 7862 - protein, 58 aa, Artificial Sequence
  Computer-generated peptide variant
KLKILRRLLRLFCRHYKHNLARECYKQRFRGARTASSFHSIGKTAVRRMLGKKALLAF

SEQ ID NO: 7863 - protein, 48 aa, Artificial Sequence
  Computer-generated peptide variant
RWRWYQRLMRMIKKFLVALGLKHIHKKELRLALLAVLRVYADPMARAV

SEQ ID NO: 7864 - protein, 31 aa, Artificial Sequence
  Computer-generated peptide variant
RYRLFTRLIKRLQRRMFAAYSKRARTADAQV

SEQ ID NO: 7865 - protein, 69 aa, Artificial Sequence
  Computer-generated peptide variant
FLKLFSKLIKMLRRMRCDDLDLFRKKALMSMAALKRGDKPLKANRMMKKQKNRAVQWIAYWCLKANKEA

SEQ ID NO: 7866 - protein, 66 aa, Artificial Sequence
  Computer-generated peptide variant
MFKLLNRFIRRWPKVQAAALLLRPKCARVSYCRSPNRRANAALLAAPGAKHKRLREKAANECDAKT

SEQ ID NO: 7867 - protein, 61 aa, Artificial Sequence
  Computer-generated peptide variant
FWRFLSKLIKFMRRKLYLDAQRDLTKLLLKKDRALLKDRAIHKQSKPCLRARAQMKKRKAM

SEQ ID NO: 7868 - protein, 51 aa, Artificial Sequence
  Computer-generated peptide variant
WLKLYRRYLKILRRLMYALRGLGMRAKWYRRKELIVMRRDVANCKRLGAIQ

SEQ ID NO: 7869 - protein, 51 aa, Artificial Sequence
  Computer-generated peptide variant
KIKLIKRWLKLMKQLFKARRRRICLFCLPAANALQFLIALVSRLLSQTGAT

SEQ ID NO: 7870 - protein, 60 aa, Artificial Sequence
  Computer-generated peptide variant
RLRLLRKLFRLMRRGHHWAAQAEIERVLLYSREFKCFAFIKFNRDLRLARRCKNLFLKKR

SEQ ID NO: 7871 - protein, 72 aa, Artificial Sequence
  Computer-generated peptide variant
LLKLLNKLIRKLPRPAWFGIQAHWAWRNQCKAAKMVHARQAWNDRNLYKFHLKAKLGRRGRKIKSALLRLQG

SEQ ID NO: 7872 - protein, 22 aa, Artificial Sequence
  Computer-generated peptide variant
ILRLLRRMMRKYRKAGPFLRWL

SEQ ID NO: 7873 - protein, 23 aa, Artificial Sequence
  Computer-generated peptide variant
RWKLLQRIFKWFRPRTLELDRLL

SEQ ID NO: 7874 - protein, 38 aa, Artificial Sequence
  Computer-generated peptide variant
KLKLFRRLFRFLSPKLLAKGNAYKWMYLCVVKNKTRIK

SEQ ID NO: 7875 - protein, 51 aa, Artificial Sequence
  Computer-generated peptide variant
RLRLFKRYFRRICCCRRLQAAGWERDLKNAAKLACKKLPARIDGLAGANWG

SEQ ID NO: 7876 - protein, 42 aa, Artificial Sequence
  Computer-generated peptide variant
RMRFFKKLLKKFQNYRFELFLDRLAKLLLLLMAYKARGEGAA

SEQ ID NO: 7877 - protein, 35 aa, Artificial Sequence
  Computer-generated peptide variant
KWKLWKKIFRKFCHPAKLKAVSLLTIGLLKKRELP

SEQ ID NO: 7878 - protein, 20 aa, Artificial Sequence
  Computer-generated peptide variant
LLRFIRRYFRLLQKTKNQNL

SEQ ID NO: 7879 - protein, 58 aa, Artificial Sequence
  Computer-generated peptide variant
KLRLFHRIFKRYKPRRKKKANIARAPMMKMLWAQPRALALLWKTYRNLHPYRWGLRDW

SEQ ID NO: 7880 - protein, 45 aa, Artificial Sequence
  Computer-generated peptide variant
KIKYLKKFLKIFCKIALKAILGQKVDWRSKFKNTTLWAALRLMKK

SEQ ID NO: 7881 - protein, 20 aa, Artificial Sequence
  Computer-generated peptide variant
RFRIFTKFLRFLSRARNLCA

SEQ ID NO: 7882 - protein, 50 aa, Artificial Sequence
  Computer-generated peptide variant
RFRLLTKWLRRLRTGREPRAATLNFRAQRANFFMADKFKLKDAKELRTTR

SEQ ID NO: 7883 - protein, 35 aa, Artificial Sequence
  Computer-generated peptide variant
KLKLLRKLMRFFCKTFLFHKCLKKRRNRAGAALTL

SEQ ID NO: 7884 - protein, 82 aa, Artificial Sequence
  Computer-generated peptide variant
KFRFYPRWMKRLKKVLRAKMKQKAHGGRCWLLLAIIPAEVALRLKKDEEDLALLLSRVELKKKVPLALAKWCLFMQLAFAYK

SEQ ID NO: 7885 - protein, 29 aa, Artificial Sequence
  Computer-generated peptide variant
KYKLMKKLFRLLRQLALLRMKRRLKHLVP

SEQ ID NO: 7886 - protein, 28 aa, Artificial Sequence
  Computer-generated peptide variant
RMRLYRRYFKKLPNRAHKVLKIRWLAAA

SEQ ID NO: 7887 - protein, 31 aa, Artificial Sequence
  Computer-generated peptide variant
FMRLFRRILKRLKKFPCKRAAATHEAARLRV

SEQ ID NO: 7888 - protein, 49 aa, Artificial Sequence
  Computer-generated peptide variant
KMKYWHKFFRLIQKLGHAKANLNDILILKKVKAKRLKHLKASDRGRAAN

SEQ ID NO: 7889 - protein, 20 aa, Artificial Sequence
  Computer-generated peptide variant
LFRLYHKIFKKLKQLKFLAV

SEQ ID NO: 7890 - protein, 31 aa, Artificial Sequence
  Computer-generated peptide variant
RMKLIRKLLKKLRHKACQRVAKYRFAADAAL

SEQ ID NO: 7891 - protein, 25 aa, Artificial Sequence
  Computer-generated peptide variant
LFKLWQKIMRLLKSLKACPLNATKE

SEQ ID NO: 7892 - protein, 24 aa, Artificial Sequence
  Computer-generated peptide variant
RLKFIKKLLKKIKRAACANKALAA

SEQ ID NO: 7893 - protein, 35 aa, Artificial Sequence
  Computer-generated peptide variant
YFKLWHRMLRYMRKTDQLSLAKYKLAVRGEARAKA

SEQ ID NO: 7894 - protein, 20 aa, Artificial Sequence
  Computer-generated peptide variant
LLRIYTRWWRKMKKKWGLAA

SEQ ID NO: 7895 - protein, 20 aa, Artificial Sequence
  Computer-generated peptide variant
RLRLMKKIWRLLRQMLAVSC

SEQ ID NO: 7896 - protein, 25 aa, Artificial Sequence
  Computer-generated peptide variant
LLRLFTRLLKRYKQGNKRKYKLAYS

SEQ ID NO: 7897 - protein, 52 aa, Artificial Sequence
  Computer-generated peptide variant
RLRWLCRLLRFISTKAARRGLKLHKLSAHPPTEPKRVCLYRANWEKAKFKAS

SEQ ID NO: 7898 - protein, 37 aa, Artificial Sequence
  Computer-generated peptide variant
RFRFMCKFLKKLNRCAKRAASRLLLHARHVTHALEGW

SEQ ID NO: 7899 - protein, 67 aa, Artificial Sequence
  Computer-generated peptide variant
MYRYLPRLWRRMKRVKKRKMRAAAYRKTDNRRPLMKMKQARAALQYATLLALVAWLPYKVKDYKYAD

SEQ ID NO: 7900 - protein, 29 aa, Artificial Sequence
  Computer-generated peptide variant
RLKMLKRLLKLYKNCLVMYRGTHKMTTRL

SEQ ID NO: 7901 - protein, 51 aa, Artificial Sequence
  Computer-generated peptide variant
ILKMMPKFLRKLKRLLKRRYPGTAEPRDLRRKLRRIVLKLLIVRAHHKTLH

SEQ ID NO: 7902 - protein, 47 aa, Artificial Sequence
  Computer-generated peptide variant
YLKFLPRLLKKWSKLLRCRVRIKFAVKLFFILARSEFGRAYRYHAKW

SEQ ID NO: 7903 - protein, 21 aa, Artificial Sequence
  Computer-generated peptide variant
YLRFYHRLMKRLRKKAADGFL

SEQ ID NO: 7904 - protein, 57 aa, Artificial Sequence
  Computer-generated peptide variant
ILRLFKRLFRKWNRLRRRQFARLYARDYLQRKLAECWKAEMSMACREAMTLHRMKKH

SEQ ID NO: 7905 - protein, 62 aa, Artificial Sequence
  Computer-generated peptide variant
RLKWFKKILRLLSKRPISLLLAKKAAALQDVKYFKWMICKKARKAAYCCRFEKTLETNAGLD

SEQ ID NO: 7906 - protein, 27 aa, Artificial Sequence
  Computer-generated peptide variant
KWRWMKKLWKFLQKRLLRATRLATHIS

SEQ ID NO: 7907 - protein, 20 aa, Artificial Sequence
  Computer-generated peptide variant
KLRFYHKIYKLLHSLARTKR

SEQ ID NO: 7908 - protein, 47 aa, Artificial Sequence
  Computer-generated peptide variant
RMKLMPKFLRFWRRTALAAREMEACQALRGALYTNKERGYAQAAKLR

SEQ ID NO: 7909 - protein, 59 aa, Artificial Sequence
  Computer-generated peptide variant
RLKFLRRFMRKFKHFKAAAALAKSKNNCPCAAALFSKRPSASCPVQKAKRLPNLERMLK

SEQ ID NO: 7910 - protein, 37 aa, Artificial Sequence
  Computer-generated peptide variant
FLKMLRKFFKRFRRAHAYDKEALLWRLRAAWGICPAK

SEQ ID NO: 7911 - protein, 77 aa, Artificial Sequence
  Computer-generated peptide variant
KMKLLRRLWKFITRLWVMGKLKHKALHQLVLGPIQKKLRHRSRSKKKFQKDCHRAAALLRFLWWMREKWKLLSGAQR

SEQ ID NO: 7912 - protein, 38 aa, Artificial Sequence
  Computer-generated peptide variant
KLKILKKYYKLIRKIKANARAWMRLLLNRHNWYANVKL

SEQ ID NO: 7913 - protein, 29 aa, Artificial Sequence
  Computer-generated peptide variant
RIKFWQRFLRLIRNALKAKRYTKLQMNAT

SEQ ID NO: 7914 - protein, 43 aa, Artificial Sequence
  Computer-generated peptide variant
RMKLIRRLIKLMRKRVFPWRLSALTLKDLALYRLVRNSEETLK

SEQ ID NO: 7915 - protein, 60 aa, Artificial Sequence
  Computer-generated peptide variant
LYRYFRRWWRRFNKRPCRMLKMAQRKLSLALKSKRSTEAKAVSACLRKFAAEIVIRLAKH

SEQ ID NO: 7916 - protein, 26 aa, Artificial Sequence
  Computer-generated peptide variant
KIKYLSRLLRLYRHLFYRRLRVRRLL

SEQ ID NO: 7917 - protein, 73 aa, Artificial Sequence
  Computer-generated peptide variant
LIKYIKRIIKRMKKLARKRSGRRPTLRLACAELRCEPIRPDAALWALAKKRGMVNRILKHYAVLLRFTPAGYK

SEQ ID NO: 7918 - protein, 76 aa, Artificial Sequence
  Computer-generated peptide variant
FWKFYHRLFKLFRREKFFLLVTRLDVLRLEGNFHKPALRGKQLGLRRNELKRMFKLAKYAKFAWLMAAPALKANAV

SEQ ID NO: 7919 - protein, 80 aa, Artificial Sequence
  Computer-generated peptide variant
RFRLIKKFMKRIKCIDLLLKKHAYAIAKAPLRKVMDMFLATKWYTLAARAALVAWLATRHDAMTGILVFRRAKIFAQARA

SEQ ID NO: 7920 - protein, 46 aa, Artificial Sequence
  Computer-generated peptide variant
KLKFMNKIFKYFNKARPLATLSADDKQRLKAALFKKDWERKLGRHR

SEQ ID NO: 7921 - protein, 29 aa, Artificial Sequence
  Computer-generated peptide variant
RLRLLHRLFKRLRKCLRTVALPKRARNAP

SEQ ID NO: 7922 - protein, 58 aa, Artificial Sequence
  Computer-generated peptide variant
KFRFLKKFFRRLRNKTAWAHLALLGICTKLVSAASSKVIKCHKEALRTRCRRARKKGH

SEQ ID NO: 7923 - protein, 37 aa, Artificial Sequence
  Computer-generated peptide variant
FLRFLSKLLRKLQKCHKSRAMTARAQALRLKAKSSSF

SEQ ID NO: 7924 - protein, 50 aa, Artificial Sequence
  Computer-generated peptide variant
RLKMFKRYFKRMKRCYILFALKYKAYQLTTKERALKDLLLLFWLALSGSI

SEQ ID NO: 7925 - protein, 29 aa, Artificial Sequence
  Computer-generated peptide variant
KWRILKKLFKLWPKYRKRVANALRTIPAL

SEQ ID NO: 7926 - protein, 29 aa, Artificial Sequence
  Computer-generated peptide variant
LYKLLRRMIRLYKRRKPNNLALQYCKLLA

SEQ ID NO: 7927 - protein, 28 aa, Artificial Sequence
  Computer-generated peptide variant
LLRLLKKFFRFLRKTCYILLPKCILRLE

SEQ ID NO: 7928 - protein, 60 aa, Artificial Sequence
  Computer-generated peptide variant
KLKLLRRMMKKLNRWGATAKPKIPTQALWDNWSCDGWRRAQRRRARLKRLLVRNHFRCAA

SEQ ID NO: 7929 - protein, 39 aa, Artificial Sequence
  Computer-generated peptide variant
FFRWIKKLMRRMSRARILRRYAADAKGAGPPHFELLLRA

SEQ ID NO: 7930 - protein, 37 aa, Artificial Sequence
  Computer-generated peptide variant
RMRFLCRLFKKWPRTAKLNLRDQAKCLFRAFQPMLKA

SEQ ID NO: 7931 - protein, 40 aa, Artificial Sequence
  Computer-generated peptide variant
RIRLYSRLLKKLHKKLAGLKMDKRRCAMRPKADQGLGYGH

SEQ ID NO: 7932 - protein, 69 aa, Artificial Sequence
  Computer-generated peptide variant
KFKYLPRLMKILTPALAPAGIRLLRPLREPAMKRKRHLDHKLRWRWVACAANIHRHLCDAELFDKARFL

SEQ ID NO: 7933 - protein, 20 aa, Artificial Sequence
  Computer-generated peptide variant
KYRLFRRMLKYWKSKALLVV

SEQ ID NO: 7934 - protein, 48 aa, Artificial Sequence
  Computer-generated peptide variant
RLKYMRRLLKMLCRHREKNRREPALAVLAAERGLRRKAPAPYAFRYHR

SEQ ID NO: 7935 - protein, 34 aa, Artificial Sequence
  Computer-generated peptide variant
KLRMMRKLLRRWKNMLQQDTLLLAHRLIAKKVDY

SEQ ID NO: 7936 - protein, 44 aa, Artificial Sequence
  Computer-generated peptide variant
LLKYLPKFLRKLKKFDAPFKLLARLFYKKEIRQKDKLRAFACCV

SEQ ID NO: 7937 - protein, 26 aa, Artificial Sequence
  Computer-generated peptide variant
WWKLLTKLFRRWSRLKPMALALKNKN

SEQ ID NO: 7938 - protein, 49 aa, Artificial Sequence
  Computer-generated peptide variant
RMRFFHKLLKLFRNAHRAAVAAMAKLLRKRVLDLRGMILKHKVMYDLMW

SEQ ID NO: 7939 - protein, 36 aa, Artificial Sequence
  Computer-generated peptide variant
KYRLFKKYLKLLCKKRSLKADWLGMYKVKLNALHYY

SEQ ID NO: 7940 - protein, 43 aa, Artificial Sequence
  Computer-generated peptide variant
RLKLFKRWIRRLKRLSKCCRKAGWARRRNLLILVPLIARGTAR

SEQ ID NO: 7941 - protein, 31 aa, Artificial Sequence
  Computer-generated peptide variant
LLKLWRRWLKILRKLIAFLLKHKWVKKCKAS

SEQ ID NO: 7942 - protein, 24 aa, Artificial Sequence
  Computer-generated peptide variant
WLRFYRRFIRRLKSAAKHQLLRAW

SEQ ID NO: 7943 - protein, 21 aa, Artificial Sequence
  Computer-generated peptide variant
KWRWLHRMLRLYNKLSAKDLE

SEQ ID NO: 7944 - protein, 32 aa, Artificial Sequence
  Computer-generated peptide variant
RWKLLSKLLRLFSCHKSRKNHFLLKRKAEFAV

SEQ ID NO: 7945 - protein, 46 aa, Artificial Sequence
  Computer-generated peptide variant
KFRLLSRLMRILRPKAEKMKLLKAFDWLKSWRDLFRKELAPSGPLR

SEQ ID NO: 7946 - protein, 44 aa, Artificial Sequence
  Computer-generated peptide variant
RMKFYRRWIRRLTRARADALWQATEAAKCCAPLRFARPLADKCW

SEQ ID NO: 7947 - protein, 36 aa, Artificial Sequence
  Computer-generated peptide variant
FLRLFSRFLRLYKHKCLQAARVDKRLAVTRGKFCVR

SEQ ID NO: 7948 - protein, 78 aa, Artificial Sequence
  Computer-generated peptide variant
FLRFITRLFRKFRKALRMKLKLKVLLLGKAKAKPLRKRKSPCAVMARGECQMEAKRQKHAFYAWNDQNACALIRELYE

SEQ ID NO: 7949 - protein, 52 aa, Artificial Sequence
  Computer-generated peptide variant
LYRLWRKFLRKLPPKLLRIAWRLGPKYRRKYLQADQSKEHLGLAQKLLKLKL

SEQ ID NO: 7950 - protein, 56 aa, Artificial Sequence
  Computer-generated peptide variant
KLRFLQKYLKRIQTKKRELQPLKIIKKFRKCHYMLWRLLLKRIYAILDAAEHILAP

SEQ ID NO: 7951 - protein, 69 aa, Artificial Sequence
  Computer-generated peptide variant
LIKFISRLLRKLRKLKYMKIAMLVAARAAVSLRNKKSYKDFHVRYKPNLAKRRQFTWRIVLHSAIRKHK

SEQ ID NO: 7952 - protein, 42 aa, Artificial Sequence
  Computer-generated peptide variant
LWKLYHRLFKLYHHLRRWLGPLKKWIVLKRAKVALHRTWLHR

SEQ ID NO: 7953 - protein, 32 aa, Artificial Sequence
  Computer-generated peptide variant
RLRFMRKYLKLIPQYAALLKDKNLRIEVDRML

SEQ ID NO: 7954 - protein, 24 aa, Artificial Sequence
  Computer-generated peptide variant
LFKLIKRWMKLLRNTERKAALYTR

SEQ ID NO: 7955 - protein, 31 aa, Artificial Sequence
  Computer-generated peptide variant
KFRWFTRLLRYIKRDILYLKKLMEFAARLNK

SEQ ID NO: 7956 - protein, 40 aa, Artificial Sequence
  Computer-generated peptide variant
LLKLLSKIMKRFKKAATSKRLALKWVGMKGGIRSIRGVNL

SEQ ID NO: 7957 - protein, 31 aa, Artificial Sequence
  Computer-generated peptide variant
RLRLFRRFMRRFNPLRINLARTALRRPEAKL

SEQ ID NO: 7958 - protein, 34 aa, Artificial Sequence
  Computer-generated peptide variant
RIRLMTRFMRLLKPSIGLKVLWDRLLRAKAKGAK

SEQ ID NO: 7959 - protein, 66 aa, Artificial Sequence
  Computer-generated peptide variant
LMKLWHKMLKLFKKKMLRKAHTLAAAPWVATHTNKRLRYRKVFALFAKRKCKLNMNKHQAQAARMK

SEQ ID NO: 7960 - protein, 22 aa, Artificial Sequence
  Computer-generated peptide variant
RWRFYSKLLRRLRHAWLRIGML

SEQ ID NO: 7961 - protein, 87 aa, Artificial Sequence
  Computer-generated peptide variant
LWKILHRFLKKFCTIHANDMRKDVGMDRARAAARNKTCNALAESLIIAKMKKGKSKKNEATAQKRVYGKLRLARLWLALALPYKARS

SEQ ID NO: 7962 - protein, 45 aa, Artificial Sequence
  Computer-generated peptide variant
LMKIYKRLYKLLRTKLKNLVESCLLYRLLVHKRKYNCAAQAWGAK

SEQ ID NO: 7963 - protein, 74 aa, Artificial Sequence
  Computer-generated peptide variant
RFKLLSKLWRKFCKPNLGHYLAKPFCLIARNTHRRAKKVLLLKAACLSHASRDCKIHATRRWCAKCKVKRAAAS

SEQ ID NO: 7964 - protein, 85 aa, Artificial Sequence
  Computer-generated peptide variant
RLKLIRRWLRLFKTGAYARCRHRGRQRALKVLRGRRLEQNLKLLQKMLALMEDLLCALDGRNGVRKDSCKKQKLGWKFKYLAPAH

SEQ ID NO: 7965 - protein, 72 aa, Artificial Sequence
  Computer-generated peptide variant
KLKLLKKILKLLRSKLFWCLWYPKAIERSRLYKHALAVRRHAALLLKTAAKLNSMTTASIFKHHMRWAANLR

SEQ ID NO: 7966 - protein, 45 aa, Artificial Sequence
  Computer-generated peptide variant
KWRLLRKLLKKFHRPVCARATMRANWKMYMNMLQAATGLYKIKLR

SEQ ID NO: 7967 - protein, 23 aa, Artificial Sequence
  Computer-generated peptide variant
RFRLYKKLLRKFSSKAWSRAVAS

SEQ ID NO: 7968 - protein, 59 aa, Artificial Sequence
  Computer-generated peptide variant
KFKLLRRLLRLIKKALRYYGACRLECRKAAWQTTKWAMLAGWAHFRRADFNYHKKASRD

SEQ ID NO: 7969 - protein, 25 aa, Artificial Sequence
  Computer-generated peptide variant
RLRWYKRLLRRLPRRKDLFKTALLH

SEQ ID NO: 7970 - protein, 90 aa, Artificial Sequence
  Computer-generated peptide variant
KLKMYKKLLKKFKSSSLRRKKCAVGKNKRVINHLEPKRLQQLVDKKGRNVMLRYAWAGLRLPGWIYLKKLQAKNKLKKDNLVNLLDAKKR

SEQ ID NO: 7971 - protein, 24 aa, Artificial Sequence
  Computer-generated peptide variant
MLKLLTKLYKKFKRYLGVMARRGM

SEQ ID NO: 7972 - protein, 42 aa, Artificial Sequence
  Computer-generated peptide variant
KLKIFSRFLKLFKKCPLKRLLSLRIRLMRVNALILTPSKRQL

SEQ ID NO: 7973 - protein, 45 aa, Artificial Sequence
  Computer-generated peptide variant
IWRFLNRYLRLWKTRLAHRLPCKKAADDPLMARTTVRLLAKVLMT

SEQ ID NO: 7974 - protein, 46 aa, Artificial Sequence
  Computer-generated peptide variant
KYKIMRRLLRKLKTQKKDNWAIAALADEHLPSFLRVRKHAANPHLR

SEQ ID NO: 7975 - protein, 60 aa, Artificial Sequence
  Computer-generated peptide variant
KIRYLKKLMRKFRCTRTKLAGLYRHAERTMFWTWKKELAAADALALANYKDKDGKKLWTC

SEQ ID NO: 7976 - protein, 26 aa, Artificial Sequence
  Computer-generated peptide variant
KLRLFKRIFKRMRRLYRLWQLLVTPL

SEQ ID NO: 7977 - protein, 76 aa, Artificial Sequence
  Computer-generated peptide variant
FFRFLNKLYRRYNRREHLKIMPADLETLLCKGRLRAWFRWRCAADKYRLSSGKRLAEAAKSSKNAKFQRLYAERKA

SEQ ID NO: 7978 - protein, 42 aa, Artificial Sequence
  Computer-generated peptide variant
IYKMWKKFLRKFQKGERQAALRSALREATKLRRAKLQRHLEQ

SEQ ID NO: 7979 - protein, 35 aa, Artificial Sequence
  Computer-generated peptide variant
RMKFYTKWFRLWQRKMRKAMLPALKCAAVKLAAVR

SEQ ID NO: 7980 - protein, 28 aa, Artificial Sequence
  Computer-generated peptide variant
MLRLWNRLLKKMRTLPFNAFIKQARAQL

SEQ ID NO: 7981 - protein, 65 aa, Artificial Sequence
  Computer-generated peptide variant
YWRIYPRMMKLLNRAHEYERRCRARAMLRRYDASAKAKNKLMRKKGLPLALMFKMKSAQRLKIRR

SEQ ID NO: 7982 - protein, 71 aa, Artificial Sequence
  Computer-generated peptide variant
LLKLMKKWLRLFRSIVVPRARDVCCKKEAAKKTKRMQEARDILQALQGLARDRSAVHAFAKKIVAKEWRAR

SEQ ID NO: 7983 - protein, 27 aa, Artificial Sequence
  Computer-generated peptide variant
LLKLIRKLFKYIPKHRRASRAWCRLLL

SEQ ID NO: 7984 - protein, 51 aa, Artificial Sequence
  Computer-generated peptide variant
RIKLWKRMLKRLKRKLAAAHCHAAIYRMRRKNALLHINCVSWRRSDRRLDS

SEQ ID NO: 7985 - protein, 53 aa, Artificial Sequence
  Computer-generated peptide variant
KLKMLKKWLKRYRHAAFLRFHELPNQVYLILKFYKRGFAVLRLKLWNYTKRKK

SEQ ID NO: 7986 - protein, 43 aa, Artificial Sequence
  Computer-generated peptide variant
RIRILKRWFKFMPKLQMLLKLRKAAKYQLYNKRDWEALKVWDL

SEQ ID NO: 7987 - protein, 56 aa, Artificial Sequence
  Computer-generated peptide variant
RYKYLTKWMKKFSKAAKNQPSALTCRLSNRARTGIKAKQWAARKKEMFRLCALKLY

SEQ ID NO: 7988 - protein, 24 aa, Artificial Sequence
  Computer-generated peptide variant
IFKFFRRMLRFLNREIARLTRLAA

SEQ ID NO: 7989 - protein, 36 aa, Artificial Sequence
  Computer-generated peptide variant
RWKLLCKYMKKLKRKDAHEFQKWAILYGLSALRLWL

SEQ ID NO: 7990 - protein, 22 aa, Artificial Sequence
  Computer-generated peptide variant
MLKFFRRLMRWLKKHAAPKWLN

SEQ ID NO: 7991 - protein, 60 aa, Artificial Sequence
  Computer-generated peptide variant
LMKWYQKMWRLLSSAQAKKAAPAQNKDAQKKRQAQTLNKLKDGKLNLRHRKLELRTIVAE

SEQ ID NO: 7992 - protein, 24 aa, Artificial Sequence
  Computer-generated peptide variant
RWRYLHRLYRRLRPAVIHRDASLA

SEQ ID NO: 7993 - protein, 66 aa, Artificial Sequence
  Computer-generated peptide variant
LFRLFKKLYRFWHKRLHDMSHARMPRERLRACRYTDIKRLLNAKRQFTSLYFRVILLAKLAKRRKE

SEQ ID NO: 7994 - protein, 23 aa, Artificial Sequence
  Computer-generated peptide variant
FLKILRKLWKYLTRKHKLTVCAR

SEQ ID NO: 7995 - protein, 62 aa, Artificial Sequence
  Computer-generated peptide variant
IMKFWCKLWKRFCPRKLLFARYLPESRFRRKYRARKRCMKQAHAKGALARAIALCCGQLARC

SEQ ID NO: 7996 - protein, 43 aa, Artificial Sequence
  Computer-generated peptide variant
LLRFLPRLLKLFRRKINLLRAILKLLKKMMRLKKAGTLKFKIP

SEQ ID NO: 7997 - protein, 37 aa, Artificial Sequence
  Computer-generated peptide variant
KLKLLKKYFRLLKQHRGWARYRALAAALRWNVLAKHF

SEQ ID NO: 7998 - protein, 30 aa, Artificial Sequence
  Computer-generated peptide variant
RLKMFRRWLKRMKKKNAHKGLFLEAIYAHL

SEQ ID NO: 7999 - protein, 51 aa, Artificial Sequence
  Computer-generated peptide variant
KYKLLKKLMRYWRNRMYRLIRAASLVKLKRKLRGCLELDAEPAFLPLTHPY

SEQ ID NO: 8000 - protein, 23 aa, Artificial Sequence
  Computer-generated peptide variant
RLKLFCKWLKRLHRSNLFYLELK

SEQ ID NO: 8001 - protein, 30 aa, Artificial Sequence
  Computer-generated peptide variant
LLRYFSRWLKKFQKLAGLPLKTKARKLLTV

SEQ ID NO: 8002 - protein, 63 aa, Artificial Sequence
  Computer-generated peptide variant
KLKFFRKLWKKMPKKSRPKKCKQKLISMLCNAVMALLLQATAIAWDRKRARESIFMCDKAAKR

SEQ ID NO: 8003 - protein, 34 aa, Artificial Sequence
  Computer-generated peptide variant
FFKLMQRLIRFWRRHAKFKSDYAIRAWAVRLLLR

SEQ ID NO: 8004 - protein, 51 aa, Artificial Sequence
  Computer-generated peptide variant
YYRMIKRLLKRIRRPLRVKEKAARAQRSLHTAKFHLCPKHQLALFFPRAAL

SEQ ID NO: 8005 - protein, 50 aa, Artificial Sequence
  Computer-generated peptide variant
KMRLIPRFFKLYNKRFARMSNPLEARKTPWACLLFKAAARAFHLKKRALC

SEQ ID NO: 8006 - protein, 87 aa, Artificial Sequence
  Computer-generated peptide variant
RFRLFCRMWRRFTKVPGSAEDTAKLLAKSKYEPKYLLLVTIQARLMDKDKKALLKNRGRMLWKLWNREKAMKGRLAQDYKKALLRFR

SEQ ID NO: 8007 - protein, 48 aa, Artificial Sequence
  Computer-generated peptide variant
YLKYLRRFFKFLKNSKAHFRMLLAAYMLRGLMRAHWTKRLKFRGRIWK

SEQ ID NO: 8008 - protein, 57 aa, Artificial Sequence
  Computer-generated peptide variant
WFRFLKKLLRRFCQAKRAMALAMLCKKYVAAMLKWSELADVRRLLAKKKARMKHLRQ

SEQ ID NO: 8009 - protein, 61 aa, Artificial Sequence
  Computer-generated peptide variant
MWRILKRLFRLLRQLDAFQLRLRENKAQLASRRSRMAAREKRRPRPLCGKKCNPGRGLRKY

SEQ ID NO: 8010 - protein, 80 aa, Artificial Sequence
  Computer-generated peptide variant
YLRFFKRLLKMWQRRWARKRLTLHAKCRPLQRKHAVRKDQLVLAAMDLAKWLKLFLISKKLQGCAKGRRRLSVMLAQKWI

SEQ ID NO: 8011 - protein, 85 aa, Artificial Sequence
  Computer-generated peptide variant
IMKLWKKYLRYFPCSAQKILVLMLWWAPELNLKMLKKRQRRWRNGLTVPQHQKNKARQKKLLIALAPAAAAKDLLIAARADIRAE

SEQ ID NO: 8012 - protein, 55 aa, Artificial Sequence
  Computer-generated peptide variant
RLKWLTKIIKYLKRMKALKPDLVINHRAVRLYLLLAAPIFRLAHANWRKDKAIAH

SEQ ID NO: 8013 - protein, 28 aa, Artificial Sequence
  Computer-generated peptide variant
KMRFLKKLLKLYRHAAKFNLSMHVEKRL

SEQ ID NO: 8014 - protein, 35 aa, Artificial Sequence
  Computer-generated peptide variant
KLRILHKMLRKLRRVLFAPCVAARCSRRNKLAISK

SEQ ID NO: 8015 - protein, 81 aa, Artificial Sequence
  Computer-generated peptide variant
RIRMLKKLIKMLKPMDRCAHDDKLKAALMHRALRRKYLKMVKKMRANGWVHIKRIRRKLALQDMLHMYIFKMALHLKAPLK

SEQ ID NO: 8016 - protein, 33 aa, Artificial Sequence
  Computer-generated peptide variant
KFKFFQRLIRKLTNFRAIFLLKQWTAAAKKLRL

SEQ ID NO: 8017 - protein, 72 aa, Artificial Sequence
  Computer-generated peptide variant
LLRLMKKILKKYKKKIARALRHRSEDRPKMLMANLPRQYQILLHDNLRIFRSKSMMPRARFKLWLALLWCFK

SEQ ID NO: 8018 - protein, 47 aa, Artificial Sequence
  Computer-generated peptide variant
KLRLMRRWLKKFKNKLMAQRKLKLHMWITPAFELWIKTKSAHNKAAL

SEQ ID NO: 8019 - protein, 42 aa, Artificial Sequence
  Computer-generated peptide variant
KIRLLQRLLRLWHKSKLQAKFMRKCNRKEALANGEANHERAA

SEQ ID NO: 8020 - protein, 29 aa, Artificial Sequence
  Computer-generated peptide variant
IYKYFKRFIKLLKCLRKAASEFLTRRFLQ

SEQ ID NO: 8021 - protein, 67 aa, Artificial Sequence
  Computer-generated peptide variant
LFRYFKRLYRIYPTRQSLRWHRRIASTKRKLAITARLWLLRRDKARARTGKRLGSLLHASMAAADGL

SEQ ID NO: 8022 - protein, 65 aa, Artificial Sequence
  Computer-generated peptide variant
RIRMMKKMFRKFRRKKALKMAAMWLWVAARMSAAPRDLKDLKAFFRRLWKCFTARSTLFHWLALR

SEQ ID NO: 8023 - protein, 75 aa, Artificial Sequence
  Computer-generated peptide variant
ILRFYKRLMKRFRRNADVPKRLLKVQQVGGNAKLRVATAKREFKAIADLALSLRKRYKKDQRDDKSLRIARALLK

SEQ ID NO: 8024 - protein, 29 aa, Artificial Sequence
  Computer-generated peptide variant
RLKLYHRFFKLIKPCVTLKDYMKRAYRLA

SEQ ID NO: 8025 - protein, 45 aa, Artificial Sequence
  Computer-generated peptide variant
WLRMLPKYIKRWRRGAYLKKAPKRNNATKRDLLRDDYKLALRATS

SEQ ID NO: 8026 - protein, 31 aa, Artificial Sequence
  Computer-generated peptide variant
MYKMLRRLLRKLQRKIEKRRMLVLAQGTKLH

SEQ ID NO: 8027 - protein, 69 aa, Artificial Sequence
  Computer-generated peptide variant
KIKMLRKLFKRYHCAQSRACVKKKLKRAKKQKLKKNRYFELRAAAMWMLQRRLDYLVARAQWAQEAAEL

SEQ ID NO: 8028 - protein, 26 aa, Artificial Sequence
  Computer-generated peptide variant
YLRLLNKFLKKFSHRVQEPKLRDLLA

SEQ ID NO: 8029 - protein, 43 aa, Artificial Sequence
  Computer-generated peptide variant
KFRLMKRWMKRICRDFLDFKKKRNYHWLLLLLRLYEKELLCSA

SEQ ID NO: 8030 - protein, 32 aa, Artificial Sequence
  Computer-generated peptide variant
LMRMFCRWLRKLRRKLEDRIALVRMAWELPHL

SEQ ID NO: 8031 - protein, 53 aa, Artificial Sequence
  Computer-generated peptide variant
IIRFWSKLLKFLKPAKTMRKRKQTVVRFLAAKLRRWRTPIKAAKCALAWYLVV

SEQ ID NO: 8032 - protein, 40 aa, Artificial Sequence
  Computer-generated peptide variant
LLKIWSKILRKMRRKSALPQERYYWNPKALASRRRKLAYW

SEQ ID NO: 8033 - protein, 56 aa, Artificial Sequence
  Computer-generated peptide variant
RYKLFTKLMRKICTHAQLTALAFVLWRRNRKDSVYAKRYLRFVLKGSAKRLAKFMR

SEQ ID NO: 8034 - protein, 29 aa, Artificial Sequence
  Computer-generated peptide variant
RYKFIKRFLRRFTKHIVELRCLKAFALAL

SEQ ID NO: 8035 - protein, 39 aa, Artificial Sequence
  Computer-generated peptide variant
ILRLFRRYFRLIRSAYQASQREPRLSNLARSLRAAKARK

SEQ ID NO: 8036 - protein, 40 aa, Artificial Sequence
  Computer-generated peptide variant
YWRLLKKYFRFYKSAILYILLECLLLAEKIDQARRHNARR

SEQ ID NO: 8037 - protein, 35 aa, Artificial Sequence
  Computer-generated peptide variant
KWKFFHKILRLLKKRRREYLCHKARALVSKQLLRL

SEQ ID NO: 8038 - protein, 47 aa, Artificial Sequence
  Computer-generated peptide variant
KWKLLHKFLKKYSRLCWPRLAQLLDFTWKAIEKADACAIARLQRQLQ

SEQ ID NO: 8039 - protein, 75 aa, Artificial Sequence
  Computer-generated peptide variant
RIRYYRRLIKKIKKPRWLKVARKQLITAGLRLTAHKPALKLKKNRFLRDCRQLMPKLAHKNLWNQFHRARKLCSM

SEQ ID NO: 8040 - protein, 83 aa, Artificial Sequence
  Computer-generated peptide variant
FIKLLQRWLKFFKRQCKADETKLMKREVRRSAICRAHRRKFDKRWSLLLVRTIAARLRESALAFELEGRQPEAAAGRLVLRYL

SEQ ID NO: 8041 - protein, 21 aa, Artificial Sequence
  Computer-generated peptide variant
FFKILKRLYRFLNKAGHWKLK

SEQ ID NO: 8042 - protein, 30 aa, Artificial Sequence
  Computer-generated peptide variant
LFKLFPRLYRKMRKQGARARRYLLYATQAQ

SEQ ID NO: 8043 - protein, 31 aa, Artificial Sequence
  Computer-generated peptide variant
ILKYLCRFLKLWRRRGLHLAVKSNCARRIAR

SEQ ID NO: 8044 - protein, 34 aa, Artificial Sequence
  Computer-generated peptide variant
RMKFIKKYFKWLTRKAAAELASCWALIEWLKVLA

SEQ ID NO: 8045 - protein, 38 aa, Artificial Sequence
  Computer-generated peptide variant
FWRLWKRLLRFFKKRLANKSIAKKHLAQHLAKNKELSK

SEQ ID NO: 8046 - protein, 28 aa, Artificial Sequence
  Computer-generated peptide variant
KLKLLSRIFRRWRKNRRQLLAAFYMLDS

SEQ ID NO: 8047 - protein, 34 aa, Artificial Sequence
  Computer-generated peptide variant
FFRILNKYFRRFTHAIRADRLALWMLARRKLAME

SEQ ID NO: 8048 - protein, 48 aa, Artificial Sequence
  Computer-generated peptide variant
KLRFYTKLWKKFKRLKLILKRVDLGQIKHTAANKLKALSAKKNKILPT

SEQ ID NO: 8049 - protein, 32 aa, Artificial Sequence
  Computer-generated peptide variant
RYRYFRKLMRIYRNRLGLYSALCLTRKLALDC

SEQ ID NO: 8050 - protein, 45 aa, Artificial Sequence
  Computer-generated peptide variant
IMKLYCRFLKRLKKARAPNKDGIKADMRRLKLMAWRNNAYATGYL

SEQ ID NO: 8051 - protein, 57 aa, Artificial Sequence
  Computer-generated peptide variant
RLRMFRKIYKYMRKCLAKKRALKMNQFGGHRAAAQVGLDAKQTKQLLKLCAFALLPT

SEQ ID NO: 8052 - protein, 49 aa, Artificial Sequence
  Computer-generated peptide variant
RLKLWRKLLRRFRCRMYAAMVKGWRLASFKQLHTCAANLRDCKGRCKVL

SEQ ID NO: 8053 - protein, 53 aa, Artificial Sequence
  Computer-generated peptide variant
ILRLYRKFLRRWPSKRQILHLADSRRNKHYKKLAIALTLACLCWHAASLRAQP

SEQ ID NO: 8054 - protein, 37 aa, Artificial Sequence
  Computer-generated peptide variant
RLRLMKRYLRRLPNKSRRQSGPRSLGAKKWLSEDWAL

SEQ ID NO: 8055 - protein, 52 aa, Artificial Sequence
  Computer-generated peptide variant
KLRFLRRIFRRLKQNARKGGRILKFQDALSLRLKNVCTMILVRGAVHLLRGR

SEQ ID NO: 8056 - protein, 43 aa, Artificial Sequence
  Computer-generated peptide variant
RMKLYKKFFRKLKPRACLYRFLCYNFEPALLVKRKLVTTLKAN

SEQ ID NO: 8057 - protein, 23 aa, Artificial Sequence
  Computer-generated peptide variant
IFKLLHKILRLFRKALDYRKRLS

SEQ ID NO: 8058 - protein, 30 aa, Artificial Sequence
  Computer-generated peptide variant
KLKWLQKLIKRFKRAQVSVLVKLKCKWLAA

SEQ ID NO: 8059 - protein, 34 aa, Artificial Sequence
  Computer-generated peptide variant
LFRWFNRFWRKLRTASIYKRKEAPAKAAALLCWC

SEQ ID NO: 8060 - protein, 31 aa, Artificial Sequence
  Computer-generated peptide variant
LMKLIKRLFKILKKCILLWERRIAWRIRARE

SEQ ID NO: 8061 - protein, 70 aa, Artificial Sequence
  Computer-generated peptide variant
FLKMMHKLWRRFKRLKCDKDAKSLDLLKAKRSQNSRARKNLKGLLKIKLKGALDACAQDSWDPASRAYMK

SEQ ID NO: 8062 - protein, 30 aa, Artificial Sequence
  Computer-generated peptide variant
LLRLWSRLMKRWKRDRKIVLACRRWAATRC

SEQ ID NO: 8063 - protein, 49 aa, Artificial Sequence
  Computer-generated peptide variant
RMKFYRKLLKKLKNIFRSKAKNADKHKPNQAKLLRLCVAFQYAYKPEDA

SEQ ID NO: 8064 - protein, 32 aa, Artificial Sequence
  Computer-generated peptide variant
LLKWLTRFFKKLRKMDIKKALDWAAWCAIYCK

SEQ ID NO: 8065 - protein, 29 aa, Artificial Sequence
  Computer-generated peptide variant
RIKFITKIYKIFTKKLRLHSAQLRAALLR

SEQ ID NO: 8066 - protein, 38 aa, Artificial Sequence
  Computer-generated peptide variant
LYKLLKRFFRMLKKDLLIRKSILREAAYKLKKLKAAAA

SEQ ID NO: 8067 - protein, 29 aa, Artificial Sequence
  Computer-generated peptide variant
LLKLYRRMFRFYKRLATAAAQEANPTHKE

SEQ ID NO: 8068 - protein, 43 aa, Artificial Sequence
  Computer-generated peptide variant
RWRFIKRFFRRYKPAQNLEQCLSMKLTKLLVIRKLSARLCAAK

SEQ ID NO: 8069 - protein, 26 aa, Artificial Sequence
  Computer-generated peptide variant
RLRLLHRLLRRFKSCARKLDALISAR

SEQ ID NO: 8070 - protein, 25 aa, Artificial Sequence
  Computer-generated peptide variant
FLKLMKKMIKKFRCDWFASLKKALI

SEQ ID NO: 8071 - protein, 31 aa, Artificial Sequence
  Computer-generated peptide variant
KFKMFRKYFKKFPTLYRAKTGAPALCALKRA

SEQ ID NO: 8072 - protein, 45 aa, Artificial Sequence
  Computer-generated peptide variant
RLRLWRKLLRWLKRRAAPHEAMKKLRYYRLRILWWMKCKENLAAY

SEQ ID NO: 8073 - protein, 37 aa, Artificial Sequence
  Computer-generated peptide variant
RMRFMSKFLKKMTRRVRRADLFKLGVWLAQRALKAEL

SEQ ID NO: 8074 - protein, 94 aa, Artificial Sequence
  Computer-generated peptide variant
RLKLLQRLFRMLSKYFLFLWWKPLAFLLLAAPKLHKAPAPAVMHRGARRRQLRKCNWAMDLLLAWSNFDSRCKRAHVVIKWLREAVAYDNRKRK

SEQ ID NO: 8075 - protein, 61 aa, Artificial Sequence
  Computer-generated peptide variant
LWKIYHRFFRLLTSAHAVAKCIRKCAAGVLYTAKKLKLLLNKLMWLLKLKLKRGAAKVNPK

SEQ ID NO: 8076 - protein, 40 aa, Artificial Sequence
  Computer-generated peptide variant
KLKLYSKYWRWLKNARRDEKKRTWMKFAELLLRGLDKAMK

SEQ ID NO: 8077 - protein, 65 aa, Artificial Sequence
  Computer-generated peptide variant
WYRFWHRWMRRFRRLYFWFHLKHSKATWKLQKKKLKLGPPDLCRSSAKLYLMRLLRARQLNKLRR

SEQ ID NO: 8078 - protein, 45 aa, Artificial Sequence
  Computer-generated peptide variant
MLKLIKKWLKKLRCKHPVRYACMSALRCWYEYLDLVARCAKKDAL

SEQ ID NO: 8079 - protein, 22 aa, Artificial Sequence
  Computer-generated peptide variant
LLRFLRKIYRRWKNARLRSWAG

SEQ ID NO: 8080 - protein, 23 aa, Artificial Sequence
  Computer-generated peptide variant
KFKLLCKLLRYLRKGHSQVRLKY

SEQ ID NO: 8081 - protein, 33 aa, Artificial Sequence
  Computer-generated peptide variant
LMRLLKKFLKRINKQRYRAANAASAIQLIMANT

SEQ ID NO: 8082 - protein, 26 aa, Artificial Sequence
  Computer-generated peptide variant
RFKILKRLLKLYKHNSLNAPMSDAKR

SEQ ID NO: 8083 - protein, 36 aa, Artificial Sequence
  Computer-generated peptide variant
LFRLMRKLFKLLPSRRKPAAAKNKFALEMKVIQQRA

SEQ ID NO: 8084 - protein, 21 aa, Artificial Sequence
  Computer-generated peptide variant
KLRLMRRFYKKYPQAVAERLL

SEQ ID NO: 8085 - protein, 79 aa, Artificial Sequence
  Computer-generated peptide variant
FYKFFKRLMRYINKFQCKEKCTWLLAQALRMARFRTLRRNKRMLKLALAKAWEKQKMIRKSKTALKTANLALERFLNFV

SEQ ID NO: 8086 - protein, 67 aa, Artificial Sequence
  Computer-generated peptide variant
LFKYIHRLMRKLSKARLSWNIYLELKGMWATALRATLPRTARNKQLDLARRRAAGRKAFQLHIAHAF

SEQ ID NO: 8087 - protein, 21 aa, Artificial Sequence
  Computer-generated peptide variant
MFRLLQRFLRKLRCLCERKVP

SEQ ID NO: 8088 - protein, 25 aa, Artificial Sequence
  Computer-generated peptide variant
KFRLLRRLFKMIKRTKQQSRAAAIA

SEQ ID NO: 8089 - protein, 20 aa, Artificial Sequence
  Computer-generated peptide variant
RLKFWKRLFKKFHKYSLAML

SEQ ID NO: 8090 - protein, 49 aa, Artificial Sequence
  Computer-generated peptide variant
LLRIFKKLLKLMNRSKKLLLFRYRWLPLLRLPARRPNLFPTRELAKSSA

SEQ ID NO: 8091 - protein, 30 aa, Artificial Sequence
  Computer-generated peptide variant
FLKFFCRMLRIFRRVRAAKRCELAKARAFK

SEQ ID NO: 8092 - protein, 52 aa, Artificial Sequence
  Computer-generated peptide variant
LFRFLKRLWRRLHQRRGELFMSSKLSRFLMMRKVRDAKKRATLKVHAVAKAP

SEQ ID NO: 8093 - protein, 20 aa, Artificial Sequence
  Computer-generated peptide variant
RFKIITKLLKFLRKHVPAGA

SEQ ID NO: 8094 - protein, 46 aa, Artificial Sequence
  Computer-generated peptide variant
WMRLMRKMLRRICHNLVALLHPHKHKAYAAIHHADRCIRRKLRKLL

SEQ ID NO: 8095 - protein, 21 aa, Artificial Sequence
  Computer-generated peptide variant
FMKYYKRMLKILRHRKATLIA

SEQ ID NO: 8096 - protein, 47 aa, Artificial Sequence
  Computer-generated peptide variant
RLRLLQKLFKMWSKPINLAQAIRRPMVAEKKAWVAKKRVLYMGLRKR

SEQ ID NO: 8097 - protein, 26 aa, Artificial Sequence
  Computer-generated peptide variant
RFRFWQRLYKKLRRCLDVLNKKAAAN

SEQ ID NO: 8098 - protein, 41 aa, Artificial Sequence
  Computer-generated peptide variant
RWRYFKRIMRILKRIPAKKKMKKNDILLADAAAYDLEWRAM

SEQ ID NO: 8099 - protein, 77 aa, Artificial Sequence
  Computer-generated peptide variant
KIRIFKRILRKWRSFLRLGRPFLMLRLARATRAALAVKFWRNAMMLNAMMKLLCVEEAWRRKASLTRAKEMLHKKWL

SEQ ID NO: 8100 - protein, 45 aa, Artificial Sequence
  Computer-generated peptide variant
WLRFLPRLLRIFCKKDGRAPALAFRKYAHRHTLNAALPKKLGMLC

SEQ ID NO: 8101 - protein, 49 aa, Artificial Sequence
  Computer-generated peptide variant
LLRLINKLLKRLRRMANALKSNYRFRDAPRGKAPKRGALRFWMVSALTL

SEQ ID NO: 8102 - protein, 91 aa, Artificial Sequence
  Computer-generated peptide variant
KMRFYRRYLKKLTRLFKLPSYCVLIKCKMFLCNKWAPCNWVLFAPLKLKARRKYDFRRARQSYLKIRMRPAHNHRDLARAQLKAQLRLLLA

SEQ ID NO: 8103 - protein, 34 aa, Artificial Sequence
  Computer-generated peptide variant
RLKLFQKMMRWIKRKMWNARAELNYEARQLLRIA

SEQ ID NO: 8104 - protein, 77 aa, Artificial Sequence
  Computer-generated peptide variant
KWKLYQRIWKLLRCPKALKRANLRKKYKKCSKKLRGNKAVAVDRLTARMFNRPTALLFKLWFQLLIKKFVGPLKKAA

SEQ ID NO: 8105 - protein, 21 aa, Artificial Sequence
  Computer-generated peptide variant
KLRFLCKLLKRWRRYLEWNNE

SEQ ID NO: 8106 - protein, 26 aa, Artificial Sequence
  Computer-generated peptide variant
FLKLWQKMYKRLRKALLELKMYNALM

SEQ ID NO: 8107 - protein, 79 aa, Artificial Sequence
  Computer-generated peptide variant
KIRMLKKMYRKFKKKAVAMLKKAYHLKKAHAFNQARSLDLAAEIYKLVRARCFLYEVINRKKMPERTWNRPLKLLNTAK

SEQ ID NO: 8108 - protein, 29 aa, Artificial Sequence
  Computer-generated peptide variant
KLRLLHKFLKRLRKKTKFNLDWNTHLASS

SEQ ID NO: 8109 - protein, 33 aa, Artificial Sequence
  Computer-generated peptide variant
LFRFFQKWLRFLRKAAKCGFARDFLKLKRARLL

SEQ ID NO: 8110 - protein, 22 aa, Artificial Sequence
  Computer-generated peptide variant
KFRLLKKLLKRFTCRNQTHLLK

SEQ ID NO: 8111 - protein, 46 aa, Artificial Sequence
  Computer-generated peptide variant
KFRWFRRLYRKLTPLKRLVRANLAATFLRLIALIAKSIALMKYRRE

SEQ ID NO: 8112 - protein, 71 aa, Artificial Sequence
  Computer-generated peptide variant
RLKLFKRLMRRIRPTGLCKKKLASMRCKRWLRQKCAMKWGWKVHLTKARALKSEPAANAMEIRMKKQIAAK

SEQ ID NO: 8113 - protein, 94 aa, Artificial Sequence
  Computer-generated peptide variant
RLKFWRKLLRKLTHLRKLAKVRCRSAAYRYRCLYAGIYPTARAIMAKAKGRKAKHCLQEKLQGALNRLMAGTAKTYWARLDMITAPRQLKWYLQ

SEQ ID NO: 8114 - protein, 67 aa, Artificial Sequence
  Computer-generated peptide variant
YLKLLKKLLKLINKKQAGRYYRCGFKNRKNCKRAWKMDFIRKDEMKPKRFDANKLLHYATRKALAAV

SEQ ID NO: 8115 - protein, 20 aa, Artificial Sequence
  Computer-generated peptide variant
YLKILCRLFKYWHTELALRR

SEQ ID NO: 8116 - protein, 67 aa, Artificial Sequence
  Computer-generated peptide variant
RFRFWRKWLRKLQPYCVYLDAHDALKDKTLMKKARRVLRPVPQRKGAKRLQLYTLLRNRLKRLLIER

SEQ ID NO: 8117 - protein, 22 aa, Artificial Sequence
  Computer-generated peptide variant
LYRLYCKILKKLNHKLRAARLP

SEQ ID NO: 8118 - protein, 76 aa, Artificial Sequence
  Computer-generated peptide variant
LFKFMRRLYKMYHKRTARRKLRLKLLFRMEEFAAAIGLDKLNKEKLLRIARRLKNWAKLKKSPFIRFVILWNHLLK

SEQ ID NO: 8119 - protein, 20 aa, Artificial Sequence
  Computer-generated peptide variant
RMRMYKRLMRLFKSLAKAWY

SEQ ID NO: 8120 - protein, 24 aa, Artificial Sequence
  Computer-generated peptide variant
RLRLFSKYIKKLRKHLEPLLFKFL

SEQ ID NO: 8121 - protein, 76 aa, Artificial Sequence
  Computer-generated peptide variant
RYRWISKMMKLFCKWKKACHAMKWRYIKNCFLAARRLKVRRGKFAGVEAKDRAANVLHACRAKSAARSALMLCLRL

SEQ ID NO: 8122 - protein, 59 aa, Artificial Sequence
  Computer-generated peptide variant
IMKMFRKWLRRFKKLSGRCKRPDFRLLARAATNKDKMPAAMAELKRRTLFFAARQAFRE

SEQ ID NO: 8123 - protein, 47 aa, Artificial Sequence
  Computer-generated peptide variant
LYRLIHKIYRKINRKMLNLPKRKFSKLSMAASQGLLLRIFRFKKKSA

SEQ ID NO: 8124 - protein, 54 aa, Artificial Sequence
  Computer-generated peptide variant
RLRYLKKFLKKMKRLERHAMTKWSKACIVFKLAAEADACHRLVAVYMRSKRQKE

SEQ ID NO: 8125 - protein, 48 aa, Artificial Sequence
  Computer-generated peptide variant
KYKLMQKLFKRLNRLQQAAKKKLAASIIRQLECARAKAKKHHRKCWKL

SEQ ID NO: 8126 - protein, 57 aa, Artificial Sequence
  Computer-generated peptide variant
RYRLIKKMYRKWRSEVKDNYCRRLLKRKLITCWLKRLASSAERRKYSLAIALPASGA

SEQ ID NO: 8127 - protein, 40 aa, Artificial Sequence
  Computer-generated peptide variant
KWRMWKKLFKRMRQRREYFAKADLVMDARRPLIYLSAGKL

SEQ ID NO: 8128 - protein, 52 aa, Artificial Sequence
  Computer-generated peptide variant
RLRIFKRWWKRYRTAKHLAPCADRCSARKRAEPRKVCLLKCAAVIAQGRLWW

SEQ ID NO: 8129 - protein, 83 aa, Artificial Sequence
  Computer-generated peptide variant
IYRLMKKMMKKLKRLKCVRFTAAAQKYLANVDWFAKMNLAADPKKSCTRERLCRAKLYAKTASCVRKFKKFLLRHKMRSYKWA

SEQ ID NO: 8130 - protein, 45 aa, Artificial Sequence
  Computer-generated peptide variant
KLRLLKKLLRKLRRCLGLCLCAFGDPAVGRWRQITPECLLNRAID

SEQ ID NO: 8131 - protein, 55 aa, Artificial Sequence
  Computer-generated peptide variant
YFRFFRKFMKRMRKAHKMAQAAERRKYKACRGGAARAWNHCLKATTFRWLLRQLK

SEQ ID NO: 8132 - protein, 46 aa, Artificial Sequence
  Computer-generated peptide variant
RIRFLRRFWRRWPKRLMPGSKALRAMLELTTKKAAARKNLLQWNPA

SEQ ID NO: 8133 - protein, 31 aa, Artificial Sequence
  Computer-generated peptide variant
KLRMMKKLLKRLKNAHKSNYKYLAAWWLKKW

SEQ ID NO: 8134 - protein, 72 aa, Artificial Sequence
  Computer-generated peptide variant
LWRFLKKMFRLFRRSARKYHIRRIMRYKHQAYKPRPAATMLRSRKAIAQVLEATNAGKKSRRAKAARLELNL

SEQ ID NO: 8135 - protein, 21 aa, Artificial Sequence
  Computer-generated peptide variant
RFRWLRKWLRRLPNRQGLTNL

SEQ ID NO: 8136 - protein, 60 aa, Artificial Sequence
  Computer-generated peptide variant
RLRLFKRWFKRINRAMHACAKRRLLPKTFQYAKTHAKLISDAEPQLPLWYARYRALKQWL

SEQ ID NO: 8137 - protein, 60 aa, Artificial Sequence
  Computer-generated peptide variant
RYRIFHRMFRKLTKYFWKELGDLLFRAKLEAECALKLLFAIARSLLLHNICLLRSMRLHK

SEQ ID NO: 8138 - protein, 34 aa, Artificial Sequence
  Computer-generated peptide variant
KLRFFKRLYKRLKKKFWDLMPLLARQAAGKKYAK

SEQ ID NO: 8139 - protein, 30 aa, Artificial Sequence
  Computer-generated peptide variant
KLRWLQKIIRLLKQMAGPQLNTLLRWMRLK

SEQ ID NO: 8140 - protein, 22 aa, Artificial Sequence
  Computer-generated peptide variant
MYKLLHRLFKMWQRLLCFKKAA

SEQ ID NO: 8141 - protein, 93 aa, Artificial Sequence
  Computer-generated peptide variant
WIRMIKRLLKLLKPLRRAEAQRAERSHEALKFRWGARILKKRALPNDVDAAFIWRKRELTRGLYLKKELAGRALNRSVDANVAALCERALMLH

SEQ ID NO: 8142 - protein, 32 aa, Artificial Sequence
  Computer-generated peptide variant
IIKLLCKWLKKIRKGTKTVLLKTKRTMLRQAA

SEQ ID NO: 8143 - protein, 43 aa, Artificial Sequence
  Computer-generated peptide variant
FLKIWKRLFKRMKQKFLICAFIEKSFLAAMLRCIKAKRRLVAK

SEQ ID NO: 8144 - protein, 66 aa, Artificial Sequence
  Computer-generated peptide variant
WLRLLKKLLKKLRQHKAFKRISRKLECRALGFRCINKRAYRLAGNSWPLCLKPLVQHRHACVCVKK

SEQ ID NO: 8145 - protein, 63 aa, Artificial Sequence
  Computer-generated peptide variant
KYKFLRKIFKRMKQFLPGALDLKIDKLRAAQVMVKLTRVLIKLLVGQKYARQKNLLLTKSEAK

SEQ ID NO: 8146 - protein, 92 aa, Artificial Sequence
  Computer-generated peptide variant
KWKMWKKLYRKLHPGKPAKKGADFLGRAKLWAEALKFRYALMLDYTLSLINSLMRAENRKKQKCRKPASAPMADRARAKRYFKGNLMNSLRA

SEQ ID NO: 8147 - protein, 54 aa, Artificial Sequence
  Computer-generated peptide variant
KLKLFKKFLRLFRRRCAAKAKYRHTIALAGIKGKPRTTRRYFQAQRAGAYGLFN

SEQ ID NO: 8148 - protein, 46 aa, Artificial Sequence
  Computer-generated peptide variant
WLKIIKRMFRMLKKRKEARLILIWRKWLGFTAMKAADRALHAIIIL

SEQ ID NO: 8149 - protein, 30 aa, Artificial Sequence
  Computer-generated peptide variant
LMRLLRKLFKKLPKLRMAQCLLRPFTLPAN

SEQ ID NO: 8150 - protein, 30 aa, Artificial Sequence
  Computer-generated peptide variant
LFRFLRKIIRWLRNRRLKGEAFLRVATQKE

SEQ ID NO: 8151 - protein, 25 aa, Artificial Sequence
  Computer-generated peptide variant
WWKLLKRLMRIMCKAGCPLTYKKLR

SEQ ID NO: 8152 - protein, 59 aa, Artificial Sequence
  Computer-generated peptide variant
LFRLIRKWIRIIKKKRLQMGHALDRDSAAFGLIRLSMHARLRRGASILTVAKRCAKRKA

SEQ ID NO: 8153 - protein, 62 aa, Artificial Sequence
  Computer-generated peptide variant
RWRFLKRLWKKWRKCKFKQTLSCFRLIDLASLVLYGKYARAAARLFLQKQALKMKHLAINIH

SEQ ID NO: 8154 - protein, 52 aa, Artificial Sequence
  Computer-generated peptide variant
LIRMLTKLLRKLTKLPNGRPPLRRTPVVRRRLKNCAWAMRLLDAPHRNDLLK

SEQ ID NO: 8155 - protein, 98 aa, Artificial Sequence
  Computer-generated peptide variant
RWRLFRKMLKKLKCGPGADRKEKFDSSRAGKCLEFQMKQLWRAQWCHGAKLRALRKMRKALAAFNMDRLLKRMLRAKTIGVAKKREKAMACIGRIYNL

SEQ ID NO: 8156 - protein, 52 aa, Artificial Sequence
  Computer-generated peptide variant
KFKFLRKMIKMFCHVLTREQMKKRARARAVLARLVQMMRDAFFLHLKNRALR

SEQ ID NO: 8157 - protein, 32 aa, Artificial Sequence
  Computer-generated peptide variant
RIRYLRRFLKMLKRKALKFEAILQFTWRLNSI

SEQ ID NO: 8158 - protein, 33 aa, Artificial Sequence
  Computer-generated peptide variant
KLKLLNKLLKRLSPADPKWLRSKACYGRPQLLW

SEQ ID NO: 8159 - protein, 25 aa, Artificial Sequence
  Computer-generated peptide variant
KFKIYKRLFRKFNKLLLAWIRDLCV

SEQ ID NO: 8160 - protein, 29 aa, Artificial Sequence
  Computer-generated peptide variant
LLKMYRKILRRLNRASLPLSVLMMPERLI

SEQ ID NO: 8161 - protein, 34 aa, Artificial Sequence
  Computer-generated peptide variant
KLKFFPRWMRKWQNAILRAEMRYKAAKAAKRTSH

SEQ ID NO: 8162 - protein, 26 aa, Artificial Sequence
  Computer-generated peptide variant
YWKLLKKWLRIFKKIACTDLAALCRN

SEQ ID NO: 8163 - protein, 22 aa, Artificial Sequence
  Computer-generated peptide variant
LMKLFRRLYKLLNRTQIKCAVL

SEQ ID NO: 8164 - protein, 72 aa, Artificial Sequence
  Computer-generated peptide variant
KWRLYPKLWRILKPKFCLLAHNAMSATMLALLRAKNGKQILPQKAQKRCYAVKCLPWFRAANKRAKKPKWLG

SEQ ID NO: 8165 - protein, 51 aa, Artificial Sequence
  Computer-generated peptide variant
LWRFYKKYFKLLQRELKYAAAKARLRMQINTDFHAEKRKQREAPRRKTSAL

SEQ ID NO: 8166 - protein, 29 aa, Artificial Sequence
  Computer-generated peptide variant
LLRYLPKLLKRFRREVKKNRLPYCYYMWA

SEQ ID NO: 8167 - protein, 55 aa, Artificial Sequence
  Computer-generated peptide variant
KFRYLRRLLKKFRHLMARLRLKTWTVRTLAGAPAAHWLVKREWNAKKNLGGKQLR

SEQ ID NO: 8168 - protein, 21 aa, Artificial Sequence
  Computer-generated peptide variant
LLRMLQKMWRRFRRKLLQNAA

SEQ ID NO: 8169 - protein, 24 aa, Artificial Sequence
  Computer-generated peptide variant
KLKLWPRFIRRLKRAWLFLKHGGG

SEQ ID NO: 8170 - protein, 34 aa, Artificial Sequence
  Computer-generated peptide variant
LWRFIPRLLRYIKRLFRKALRRAMFQLQHVLHWL

SEQ ID NO: 8171 - protein, 28 aa, Artificial Sequence
  Computer-generated peptide variant
RMKLYPRLWKFWSRLAKLDTLRKLLRWR

SEQ ID NO: 8172 - protein, 29 aa, Artificial Sequence
  Computer-generated peptide variant
RLKLIKKLWKKLHTKKTKQLNWARCAWLV

SEQ ID NO: 8173 - protein, 20 aa, Artificial Sequence
  Computer-generated peptide variant
KWRLLCRIYKMWQKRLFALV

SEQ ID NO: 8174 - protein, 33 aa, Artificial Sequence
  Computer-generated peptide variant
LLRFMKKILKLFTKKLNPGGRKYGLRAHNKLSK

SEQ ID NO: 8175 - protein, 43 aa, Artificial Sequence
  Computer-generated peptide variant
RFRYFKKLLKKFKKPCLKRGKLQENKEALSGVKKRYVLLLVAL

SEQ ID NO: 8176 - protein, 100 aa, Artificial Sequence
  Computer-generated peptide variant
KMRLLHRLLKYLRCKCAMAATWPADPKKLDSKYFYLSEALGRALKAGKALQVLGAKQRKKVRVLWFLVKWLKERAIMTMDALPDSWAGRRAVLKINAEAA

SEQ ID NO: 8177 - protein, 51 aa, Artificial Sequence
  Computer-generated peptide variant
KMKLLTKYLKRLTKLKARAADIVKIALFQLFQPKQAKYLMKAKQAQYAITA

SEQ ID NO: 8178 - protein, 54 aa, Artificial Sequence
  Computer-generated peptide variant
FMKILKRFFRLMPRKELLRHHACCHRQNRLAERLAYALALHALSRIRCHDLKLC

SEQ ID NO: 8179 - protein, 67 aa, Artificial Sequence
  Computer-generated peptide variant
LMRMLRKILKRFRTRLVARTATRDYLYFLKHACKRARPKTGQLDRLLKAQVLKIFRVMGMDRKQAIK

SEQ ID NO: 8180 - protein, 87 aa, Artificial Sequence
  Computer-generated peptide variant
LYRLFCRFLRKFRRVVRAEKINAYACVKRLKILAQLPFVARRWLLNRKCKAHLRKFARSSLRKENEGEKLRALLHGCGRDQRKMLAL

SEQ ID NO: 8181 - protein, 43 aa, Artificial Sequence
  Computer-generated peptide variant
KFKLLSRYLKLYCNEAKKQHEALYDRLGHAWVLKERRLKWNLK

SEQ ID NO: 8182 - protein, 63 aa, Artificial Sequence
  Computer-generated peptide variant
RIKYMRRWLRRMRKEIYACAELRLKDPLATLRNLNLALAGDHLKLQEFAYVCKAADLKMCKKQ

SEQ ID NO: 8183 - protein, 94 aa, Artificial Sequence
  Computer-generated peptide variant
KLKFLSRLLKRLTHRTLRAKNNKAIWDLINFYSIALLECREAIKMWKRFAMCRKACGLARKKAFTSKPLCAWKWRTKGLKIARLKCQDKAAAIS

SEQ ID NO: 8184 - protein, 59 aa, Artificial Sequence
  Computer-generated peptide variant
RLKFIKRLLRRLQRATYLLFKVCAGHYRWARAITRLRLLGWHWRLRWRRLTLIAKLFIH

SEQ ID NO: 8185 - protein, 49 aa, Artificial Sequence
  Computer-generated peptide variant
KMKIYKRLYKKMHKPMSFWGANRSDVHKAKGLLKAAARCRACKRDALSL

SEQ ID NO: 8186 - protein, 27 aa, Artificial Sequence
  Computer-generated peptide variant
KIRFLTKLFKLLKPRLKKLKKANWLTA

SEQ ID NO: 8187 - protein, 67 aa, Artificial Sequence
  Computer-generated peptide variant
KFKILKRIFRRLKSEFNDLKATALDADYCVFRDACLRAKKTWFANMSRDNWKCKLGLRRALLRKKNA

SEQ ID NO: 8188 - protein, 40 aa, Artificial Sequence
  Computer-generated peptide variant
KFKFMKRFLKRIKRRHPDLPSGQDFDLLRRLATAARAADQ

SEQ ID NO: 8189 - protein, 91 aa, Artificial Sequence
  Computer-generated peptide variant
RLRLFKKYWRLMHKANLAKKQQNHLREPLMKGRRYKWKRKDRRNAAKGTRHLDHLKQAHHLRCAMTPKYALGLKMMDDRRKLRLACQAEYA

SEQ ID NO: 8190 - protein, 98 aa, Artificial Sequence
  Computer-generated peptide variant
KLKLLRRLIRMLRPRIGKHTLKRLMMKNPTRMATLLCLDPRMLEDNNLQRARLALSNTLCRFSSKAKRLFLKDSKKFAKRGAWVKKLLDKWLLRRTAT

SEQ ID NO: 8191 - protein, 46 aa, Artificial Sequence
  Computer-generated peptide variant
LMRILCRLLRMLCKRKCRQVSTIFLNMRRLYLLLLQLARMELFKCK

SEQ ID NO: 8192 - protein, 60 aa, Artificial Sequence
  Computer-generated peptide variant
KMKFLSKYLRLMHRANACILRSKLSMAQLPWQLRRRHLLNLKADARRSWHEIRKHALNRM

SEQ ID NO: 8193 - protein, 72 aa, Artificial Sequence
  Computer-generated peptide variant
YFKFMKRIWRFFRRKKLRDARLAKVEANRNFPLARRGRAVKCKLYRPAWRLAAAARIVKTLNAVELHVTLKR

SEQ ID NO: 8194 - protein, 64 aa, Artificial Sequence
  Computer-generated peptide variant
ILRLLQRYLRKWQRPLHATALEGSRTWDKRWRKRHAAHLSLRLHKDRFAKLRAAIRGCAAFLKA

SEQ ID NO: 8195 - protein, 38 aa, Artificial Sequence
  Computer-generated peptide variant
ILRFMRRLFKLIQKAAKKQAIWSKGRVWRVAYAKAKIM

SEQ ID NO: 8196 - protein, 55 aa, Artificial Sequence
  Computer-generated peptide variant
RLKLFRKYLKKFKRKLNADLTSSLIRLAVRHKHNKLKYPVACQYRLCLPALYSAM

SEQ ID NO: 8197 - protein, 49 aa, Artificial Sequence
  Computer-generated peptide variant
KFRWFQRMFKRLKRLKLIRRKGRKKLATMISQRPEWRLAEFAALLAAKV

SEQ ID NO: 8198 - protein, 34 aa, Artificial Sequence
  Computer-generated peptide variant
YLRLIRRFLKYFCKRKLDVAWANWAAVQQAARGK

SEQ ID NO: 8199 - protein, 20 aa, Artificial Sequence
  Computer-generated peptide variant
ILRYYNKLIKLFNKIALKAG

SEQ ID NO: 8200 - protein, 72 aa, Artificial Sequence
  Computer-generated peptide variant
KLKYLRRILKKLCRRFWRDRFWATCRHKELLKAVNMCAHLCMKLLRYLRRRCLMNAWQALAIRFYCRNKHAQ

SEQ ID NO: 8201 - protein, 23 aa, Artificial Sequence
  Computer-generated peptide variant
FLRLWTKFFKRLQKAYALLCCKD

SEQ ID NO: 8202 - protein, 32 aa, Artificial Sequence
  Computer-generated peptide variant
KLRILRKLLKKLSPRKCWADMQQANAMRRLHK

SEQ ID NO: 8203 - protein, 23 aa, Artificial Sequence
  Computer-generated peptide variant
KMRLYHRLWRFLHHNRDAKQLLR

SEQ ID NO: 8204 - protein, 52 aa, Artificial Sequence
  Computer-generated peptide variant
WYKIYKKLWRIYRRLNSRRSACLRFMNLALKKKAAQKRLWRAKYKVRNLSLQ

SEQ ID NO: 8205 - protein, 79 aa, Artificial Sequence
  Computer-generated peptide variant
KLKLYRRMIRWFRKFSDKKVQRCVAWLAKALPIAKMARALVAFKVLVKWILRILFLDRGARNCKHEYERRLASRKCIAA

SEQ ID NO: 8206 - protein, 86 aa, Artificial Sequence
  Computer-generated peptide variant
KYRFFKRIWKLYKKARNAKPLHRRDHCFALLANQLPAILGLAKQSRYLLGRKSWRKCCKSKYEALREVNILAPDKRKARADKASVK

SEQ ID NO: 8207 - protein, 31 aa, Artificial Sequence
  Computer-generated peptide variant
IMKFLNRFLKFWKKNKTPYARARALARLFRT

SEQ ID NO: 8208 - protein, 37 aa, Artificial Sequence
  Computer-generated peptide variant
KLKLYQRIYRLLHSNANMVRDKFLRRKLLQASMKRMR

SEQ ID NO: 8209 - protein, 20 aa, Artificial Sequence
  Computer-generated peptide variant
KLKMLCKYLKLWKRASCLKA

SEQ ID NO: 8210 - protein, 32 aa, Artificial Sequence
  Computer-generated peptide variant
RLRYLRKLLKKLTRFRDNLKFGIRKLCTYINL

SEQ ID NO: 8211 - protein, 56 aa, Artificial Sequence
  Computer-generated peptide variant
FLKLFRKYFKYFPRCLDKMQHVNLWLLLKLTAAEFLWFKRTRLKQRMLPAKRRGRA

SEQ ID NO: 8212 - protein, 49 aa, Artificial Sequence
  Computer-generated peptide variant
KFRLLKRFWRFLKHAGLVRLIGRLTLLTKARAPLLDSEAKRWKRRVWAI

SEQ ID NO: 8213 - protein, 96 aa, Artificial Sequence
  Computer-generated peptide variant
LLRLLQRFLKIFKSLKAAVESAALVPARVIYRPQAHRKLCKVDLKLKIWYRATIRACKYAKAKKRQERYAFTGMAAWKGHTQRLLRKELKVRMNRR

SEQ ID NO: 8214 - protein, 59 aa, Artificial Sequence
  Computer-generated peptide variant
RFRLMRKFWRWWKNTKSMWRPIQLRLVFAARLGKRQMLRYRAADPALAAKMRAVQTLRL

SEQ ID NO: 8215 - protein, 46 aa, Artificial Sequence
  Computer-generated peptide variant
RIRWIRRLYRKFKRLKARLWGEKRFWCALKKLYALATTECLRLKLQ

SEQ ID NO: 8216 - protein, 72 aa, Artificial Sequence
  Computer-generated peptide variant
LIRLYPKFMRLFPNGWIRHGARECKYLGKRAWRQIADLAEKCMAKAKKNARLRLRNKLWAKAMAKKKSIYML

SEQ ID NO: 8217 - protein, 27 aa, Artificial Sequence
  Computer-generated peptide variant
RIRWLKKYYRLIKPGFLALDARDPLKM

SEQ ID NO: 8218 - protein, 25 aa, Artificial Sequence
  Computer-generated peptide variant
WMRMLRKLLKFMKCSMRAARFAKLT

SEQ ID NO: 8219 - protein, 39 aa, Artificial Sequence
  Computer-generated peptide variant
RLRILNKLFKRYRQWKCLLAALLKQSKKLGRHKTMWCCH

SEQ ID NO: 8220 - protein, 21 aa, Artificial Sequence
  Computer-generated peptide variant
RLRFFKKLLKRFKPKLLLDAR

SEQ ID NO: 8221 - protein, 21 aa, Artificial Sequence
  Computer-generated peptide variant
WLKMLRRLFKLFHRDCTSRKA

SEQ ID NO: 8222 - protein, 37 aa, Artificial Sequence
  Computer-generated peptide variant
KLKLWRKLYKIYRRLMWDRLGLFFCTFAGARKMRALA

SEQ ID NO: 8223 - protein, 43 aa, Artificial Sequence
  Computer-generated peptide variant
KLKFMRRWFRILQKKGKEQLKKRINCRMKGMPVLAPAALKLAL

SEQ ID NO: 8224 - protein, 29 aa, Artificial Sequence
  Computer-generated peptide variant
RLRLLKRWYKLLRKAALTHWRWPQTCGDA

SEQ ID NO: 8225 - protein, 31 aa, Artificial Sequence
  Computer-generated peptide variant
RIRLLRRIFKLWRKYKLRVLSHYCLIKYALS

SEQ ID NO: 8226 - protein, 50 aa, Artificial Sequence
  Computer-generated peptide variant
MLKLWKRMLRKIKKLRRAARCYAAKIQLLWVQLAMASYLGRKYCKWRRAL

SEQ ID NO: 8227 - protein, 48 aa, Artificial Sequence
  Computer-generated peptide variant
KIRMFNKFLKKWNNALLRDRLMLIKLSYRALATLHRRKEARKLAKSKK

SEQ ID NO: 8228 - protein, 89 aa, Artificial Sequence
  Computer-generated peptide variant
MLRLLRRLMKLFKTHAKKLLLKALHKHSKATAKIDARLIRAKKLIVRRRPTELKCRQKEVRNSHLCRRKTACCLKAKANNSCQLPMDAQ

SEQ ID NO: 8229 - protein, 36 aa, Artificial Sequence
  Computer-generated peptide variant
WMKLYKKYFKYLSTCALLIKKYALWQVRARELLRKL

SEQ ID NO: 8230 - protein, 69 aa, Artificial Sequence
  Computer-generated peptide variant
RLKFLKRLFKKFPKRGIQKWRRAQAAAAGVKLSDKCRHLARQHKLRAVDEELEKTKLRADRRIAIQIII

SEQ ID NO: 8231 - protein, 58 aa, Artificial Sequence
  Computer-generated peptide variant
KMKLWRRFLRKYRTRTKNAARTWRYGCRMKKPELPLLKKQTVYALMHALVYPKWARLA

SEQ ID NO: 8232 - protein, 64 aa, Artificial Sequence
  Computer-generated peptide variant
LLKYLNRLLKKWQRNNKMLRKHARGKATRREALRPHKEVVLMNGACRAAGADKRPWYVKRQALE

SEQ ID NO: 8233 - protein, 23 aa, Artificial Sequence
  Computer-generated peptide variant
RLKLIKKLWKRIKPARLKCTALV

SEQ ID NO: 8234 - protein, 23 aa, Artificial Sequence
  Computer-generated peptide variant
KLRIFCKLLRMMRRDWRQATALR

SEQ ID NO: 8235 - protein, 31 aa, Artificial Sequence
  Computer-generated peptide variant
RLRIWKRIFKKLKRAKFKLACMKCKLLLAAN

SEQ ID NO: 8236 - protein, 28 aa, Artificial Sequence
  Computer-generated peptide variant
LLRMFRKLLRRYTKQYARLFINRIRDLD

SEQ ID NO: 8237 - protein, 23 aa, Artificial Sequence
  Computer-generated peptide variant
RYKLLKKMFRRYCKWKAFQGLLA

SEQ ID NO: 8238 - protein, 36 aa, Artificial Sequence
  Computer-generated peptide variant
RLKIWRRLLKIIKKKKKGYACVFIILAAQLKALDWS

SEQ ID NO: 8239 - protein, 47 aa, Artificial Sequence
  Computer-generated peptide variant
RMKWLTRFLKRFNRALICYERLAIRLALDRRAIDVLIQAMKKRCRWD

SEQ ID NO: 8240 - protein, 40 aa, Artificial Sequence
  Computer-generated peptide variant
LWKFFRKFFRLMKKDLQRKLLRATAAQADLYLLAFKRNRK

SEQ ID NO: 8241 - protein, 43 aa, Artificial Sequence
  Computer-generated peptide variant
KWRLFRKFFKKWHRAHKRKLSLRDCKLLYNQDAWHRLRNLVAF

SEQ ID NO: 8242 - protein, 41 aa, Artificial Sequence
  Computer-generated peptide variant
RLKMLSRMFKRLRHAGRCRKAARAACQAYAKFIVWHWHKAI

SEQ ID NO: 8243 - protein, 50 aa, Artificial Sequence
  Computer-generated peptide variant
KWRLFKRIWRWFKKLAKKRTKAESLLANHAVKLLKLLKGRLQLCYLLVKK

SEQ ID NO: 8244 - protein, 58 aa, Artificial Sequence
  Computer-generated peptide variant
LIKMIRKLWRWFRKGRDRSALKAYKHKVLWAVAPKRLADDELLLNRNNFAKHKKQFFL

SEQ ID NO: 8245 - protein, 20 aa, Artificial Sequence
  Computer-generated peptide variant
LLRLYCKLFKKFRTIKTQAI

SEQ ID NO: 8246 - protein, 20 aa, Artificial Sequence
  Computer-generated peptide variant
YLRLLHRLFKYMRRRQLDNM

SEQ ID NO: 8247 - protein, 57 aa, Artificial Sequence
  Computer-generated peptide variant
RFKMFKKFYRKFKRKKLRRYWYPAARFKKPKAPFLALPALRWIDLKTKAPHAISALY

SEQ ID NO: 8248 - protein, 38 aa, Artificial Sequence
  Computer-generated peptide variant
KMRMMRRLFRRLCRRKNVAALRIKNALLWLPRGMRECL

SEQ ID NO: 8249 - protein, 67 aa, Artificial Sequence
  Computer-generated peptide variant
RIRIYKRLIKRLCKHGQRRAAWKPLGYKAARNIKALCARTQRGIKLKFTRMKGAALLCVLLKELYKS

SEQ ID NO: 8250 - protein, 56 aa, Artificial Sequence
  Computer-generated peptide variant
KWKMWHRWLKYLKKLRSERHARQKFHLSDKKTALGHLATTACRWGNATAKRRAKRV

SEQ ID NO: 8251 - protein, 30 aa, Artificial Sequence
  Computer-generated peptide variant
FLRLLPKIMKKIQKKLRLFNKGAMLRALHF

SEQ ID NO: 8252 - protein, 24 aa, Artificial Sequence
  Computer-generated peptide variant
KYKLYQRLMRKFKRVYPARIACAA

SEQ ID NO: 8253 - protein, 32 aa, Artificial Sequence
  Computer-generated peptide variant
RLKMLRKLLKKFCSLNHKTGAALPASAQPKMR

SEQ ID NO: 8254 - protein, 37 aa, Artificial Sequence
  Computer-generated peptide variant
YIKFMSKWLKLMPKKALLLVSARYHARLFRIRDKKAP

SEQ ID NO: 8255 - protein, 29 aa, Artificial Sequence
  Computer-generated peptide variant
MLRLLKKMFRKYKQMEALEWKCLARYLAA

SEQ ID NO: 8256 - protein, 22 aa, Artificial Sequence
  Computer-generated peptide variant
RIRLFNKLIKKLRKGGRALLNG

SEQ ID NO: 8257 - protein, 31 aa, Artificial Sequence
  Computer-generated peptide variant
WIRLLKKYYKKFNSGVRAEKRLASKLLAAYF

SEQ ID NO: 8258 - protein, 25 aa, Artificial Sequence
  Computer-generated peptide variant
WLKMLKKLFKFIKRKGAEPLQAAAR

SEQ ID NO: 8259 - protein, 35 aa, Artificial Sequence
  Computer-generated peptide variant
WLKLFKRYLRKMQTRKAPHSLRRAARLAILASAHK

SEQ ID NO: 8260 - protein, 67 aa, Artificial Sequence
  Computer-generated peptide variant
FWKLMCRFFRRWRSYGVKCLSKKSATERRRAKCVHRARALLNTRVPQRAWHELLAALNKRKYRLRFA

SEQ ID NO: 8261 - protein, 34 aa, Artificial Sequence
  Computer-generated peptide variant
RLKLYRKWLRWFCRCGPMKLNKELGLKAALKSPN

SEQ ID NO: 8262 - protein, 90 aa, Artificial Sequence
  Computer-generated peptide variant
WMRMYKKLIKWFQNQQVHKLRQLPVTRRRLKTAIRLQELVAPKAARKELARCHFFFKRLPAARKYRKTLKVWALKAARRERKANWMVTAR

SEQ ID NO: 8263 - protein, 55 aa, Artificial Sequence
  Computer-generated peptide variant
YLKLIRKMYKKLRHWRFKFPLDFKRMHRRYIAKLIKLRKALIYAAWDRQCAPAQA

SEQ ID NO: 8264 - protein, 28 aa, Artificial Sequence
  Computer-generated peptide variant
MLRWLKRFFKRLKQAGTDKRIKLLALAR

SEQ ID NO: 8265 - protein, 81 aa, Artificial Sequence
  Computer-generated peptide variant
YLKFFNRLFRRITKMTAFRAKNLKFEFLRAHSKMLSDMRSAKKTRRKRRAARRAWGKPALNARWPLARNKYKTFLYVKLLD

SEQ ID NO: 8266 - protein, 38 aa, Artificial Sequence
  Computer-generated peptide variant
YLRIYRRIFKRMPTWTCAVGAFGLAKKAKLKPAKKAKY

SEQ ID NO: 8267 - protein, 48 aa, Artificial Sequence
  Computer-generated peptide variant
YYRFMQRLLRKYKQLLRKKLCKGAHKAQAFKFKVVCTAAYKWAAAMPL

SEQ ID NO: 8268 - protein, 41 aa, Artificial Sequence
  Computer-generated peptide variant
RLKMLNKLFKRFKCLQKMHRRRIAEPSLAIVNRLNLLALTH

SEQ ID NO: 8269 - protein, 25 aa, Artificial Sequence
  Computer-generated peptide variant
ILKILPKLMKILSKCRAHLAATTRE

SEQ ID NO: 8270 - protein, 24 aa, Artificial Sequence
  Computer-generated peptide variant
FYRFLRKLLRLLQSPKLMKSRRCA

SEQ ID NO: 8271 - protein, 28 aa, Artificial Sequence
  Computer-generated peptide variant
KFRLWRKLFRIWQKRLGERLLLPAQQPR

SEQ ID NO: 8272 - protein, 41 aa, Artificial Sequence
  Computer-generated peptide variant
KFKWLRRWLRFLKSKDYKHFILKKCERSTLKAWAKALARAL

SEQ ID NO: 8273 - protein, 24 aa, Artificial Sequence
  Computer-generated peptide variant
RLKLLKKWLRLFHQACLRVKQEPM

SEQ ID NO: 8274 - protein, 57 aa, Artificial Sequence
  Computer-generated peptide variant
KLKWMQKLIKKLRTKVLWRFKFAWRYAKRSLAMLKDYCPFALKRKKLRLILTICNWF

SEQ ID NO: 8275 - protein, 87 aa, Artificial Sequence
  Computer-generated peptide variant
KLRLWTKLLRLLKRHALLHMPVLLRDRNWKGKALAWHIGHHELLFFRLQNHRHRRKIFRRDCKLAAQRGPHKREIFKRFLSHALKKV

SEQ ID NO: 8276 - protein, 21 aa, Artificial Sequence
  Computer-generated peptide variant
LLKYWRRLWRRMHKKMLYAAV

SEQ ID NO: 8277 - protein, 61 aa, Artificial Sequence
  Computer-generated peptide variant
ILRMMKRFLRFMKKYTPLYGNNRAAKARPCTKHETELRLHLHALKRACKNLLWRKKKRYVK

SEQ ID NO: 8278 - protein, 49 aa, Artificial Sequence
  Computer-generated peptide variant
KMRFYKKMWKRMKNMLNAQKLFRLWCACMAVALLLNRRMAAGLARDITA

SEQ ID NO: 8279 - protein, 27 aa, Artificial Sequence
  Computer-generated peptide variant
RYKLFKKWFRFWHRQEAWAEKAKQAAL

SEQ ID NO: 8280 - protein, 75 aa, Artificial Sequence
  Computer-generated peptide variant
MYKLMKKYFRRFRHDFIARLVFKKLSLHSMKAARLRANARRALKVRERAILTDGMFEKRIFAWAKATTRKRAYKR

SEQ ID NO: 8281 - protein, 41 aa, Artificial Sequence
  Computer-generated peptide variant
YIRWYKRFYKRFRRGNLERRRHRAAFCIEQLAKRLLYEALL

SEQ ID NO: 8282 - protein, 79 aa, Artificial Sequence
  Computer-generated peptide variant
RMKLLCKYWRKLKQLARQAMTEKLKHERRALVAKAVKLKVSRGIRCVALARCEQKSAAWRCRQKDVHSRRELAALWFNR

SEQ ID NO: 8283 - protein, 29 aa, Artificial Sequence
  Computer-generated peptide variant
LWRYYPKFFRIWPKDLMAKVLDARKRLRA

SEQ ID NO: 8284 - protein, 92 aa, Artificial Sequence
  Computer-generated peptide variant
KIRWLRRYFKFLTKLRGAQRLWKAAHMQKLKQWKRTAHFNQAEASKKCLALKFLFWRLRLLSLTLFARKRKSLKDAKWYELVWTALAMRHNW

SEQ ID NO: 8285 - protein, 32 aa, Artificial Sequence
  Computer-generated peptide variant
LFRMFTKLLRRLRRLTRRMMKQLYLKEEHQPA

SEQ ID NO: 8286 - protein, 67 aa, Artificial Sequence
  Computer-generated peptide variant
RFKLMSRMLRKIRKDPPRLKAAADRLQADDVGKKLLQLYDFRLASKRKAKADRNKLITYYRLLAKRK

SEQ ID NO: 8287 - protein, 25 aa, Artificial Sequence
  Computer-generated peptide variant
LYRIFRRWMRRFPKAKFLLLSIRDA

SEQ ID NO: 8288 - protein, 31 aa, Artificial Sequence
  Computer-generated peptide variant
LMKLFKKFLKRYCRAHAHLEAIAKLTARILK

SEQ ID NO: 8289 - protein, 98 aa, Artificial Sequence
  Computer-generated peptide variant
FLKIWKKYFRYLHTLKAKETTLSAALSALIAPMLFRMAAKFFVRYLCKYRAKLAKRPPARYPKLRQSKKCLSLIYLFLRKRDCNLNKDRLIKLLVYIK

SEQ ID NO: 8290 - protein, 81 aa, Artificial Sequence
  Computer-generated peptide variant
MIRFITKIFRRLRKLLSLLKKLDLMLRPPRLVAWLMAIQKIRRALYADRMTALIKLLLLAYCRLEYWKCAAQHDKRYLRLM

SEQ ID NO: 8291 - protein, 21 aa, Artificial Sequence
  Computer-generated peptide variant
KLRYLRKFLRKFHRLSEAARA

SEQ ID NO: 8292 - protein, 50 aa, Artificial Sequence
  Computer-generated peptide variant
MLKLYPRILRLFRKLPKVNRERAGLKFAKRKHRGVWLTAYLWQSMARKAY

SEQ ID NO: 8293 - protein, 75 aa, Artificial Sequence
  Computer-generated peptide variant
KFRYWHRFFRRICSRAGGLLLDARGARHGLQAKERAHRCRKEKLIQLQQKLLDLVLAGEKRRRPAAIGKAALCEK

SEQ ID NO: 8294 - protein, 43 aa, Artificial Sequence
  Computer-generated peptide variant
RLKLWNKLLRRFKRCTTNAPLIRTIRKLASAAIRKWCWKYALP

SEQ ID NO: 8295 - protein, 88 aa, Artificial Sequence
  Computer-generated peptide variant
KMRMFTRLFKRLRKAKRNLPLRAARRWLAMKLKRPHRDLAVWRARYKAGAQKSVPCPFADKVRKCMREALDTWRARKAMKRILAHKYL

SEQ ID NO: 8296 - protein, 56 aa, Artificial Sequence
  Computer-generated peptide variant
KFRWLKKFLRKFRSAMQARDKDAAARWNRINLKKKNHWLAILSLRMWAPLFGAVKR

SEQ ID NO: 8297 - protein, 49 aa, Artificial Sequence
  Computer-generated peptide variant
RLKWLCRYWKRIQTKAKWKRLCHPQFARRDTDAIRLAAKMRLKYWARLL

SEQ ID NO: 8298 - protein, 41 aa, Artificial Sequence
  Computer-generated peptide variant
LYRLYKKFWKLFKKALAKLLMQANLKAYRKKLYPFLGSQSM

SEQ ID NO: 8299 - protein, 21 aa, Artificial Sequence
  Computer-generated peptide variant
KFKLFKKYLRLLKKHHVKLAF

SEQ ID NO: 8300 - protein, 31 aa, Artificial Sequence
  Computer-generated peptide variant
KIKLMKRLLRLFRRAAQYRFDRHVLKLKMYA

SEQ ID NO: 8301 - protein, 27 aa, Artificial Sequence
  Computer-generated peptide variant
RLKLWQKLMKKFKQTTFLDRMHKAAFA

SEQ ID NO: 8302 - protein, 39 aa, Artificial Sequence
  Computer-generated peptide variant
KLKLYRKMYKLLHKKEEKAIYKAARAKAAPINRCGWFKL

SEQ ID NO: 8303 - protein, 31 aa, Artificial Sequence
  Computer-generated peptide variant
RMRLLRRILKWMKKWKANMPDLGLAAKLDDN

SEQ ID NO: 8304 - protein, 40 aa, Artificial Sequence
  Computer-generated peptide variant
LIRLFKKLLRFIRKAKRGKVADAREAAICKLELEAQGFNL

SEQ ID NO: 8305 - protein, 66 aa, Artificial Sequence
  Computer-generated peptide variant
KFRFFKKLFKWWRTDRRNRKGAVRSLRLRALHRRTDKALLLKAAYFWLARDDEYAQCKPGLKAAVK

SEQ ID NO: 8306 - protein, 83 aa, Artificial Sequence
  Computer-generated peptide variant
FLRMLKKWMRRYSQRLSKAQAAPLLALRRKDLKPLGPKDLFAQVHHLKNWGRGRGKEHKKKKWRTTQVLRALQELRACKNAKH

SEQ ID NO: 8307 - protein, 53 aa, Artificial Sequence
  Computer-generated peptide variant
RFKIMTKLLRRLRQKLLKLAFRYSQEKIEALGSLLLVKRKDKKYQNPRNNFLR

SEQ ID NO: 8308 - protein, 20 aa, Artificial Sequence
  Computer-generated peptide variant
RLRMLQRILRRLTRLTLCYW

SEQ ID NO: 8309 - protein, 57 aa, Artificial Sequence
  Computer-generated peptide variant
RMKLFKKYLRKWKSPAARTIQKDADLKMRLLRTEKKCASLANVHYKAKKLEPKYGLR

SEQ ID NO: 8310 - protein, 28 aa, Artificial Sequence
  Computer-generated peptide variant
KLKLLSRIIKKFKRDLGQSRITEAAACK

SEQ ID NO: 8311 - protein, 28 aa, Artificial Sequence
  Computer-generated peptide variant
KFRIYRRIYKMMNRARPYLLWFAAKLLR

SEQ ID NO: 8312 - protein, 94 aa, Artificial Sequence
  Computer-generated peptide variant
KLKLMKRYIRKIKRHLCDAACAARLWKSLAKSFWLRWRKKLYVPARIKAMACFVLFKLDKATPCKATKKDFGHKRAQARRCIRAFRQKRLCINT

SEQ ID NO: 8313 - protein, 26 aa, Artificial Sequence
  Computer-generated peptide variant
KFRLFRKIFKKLNHPEMGLKALKLRL

SEQ ID NO: 8314 - protein, 99 aa, Artificial Sequence
  Computer-generated peptide variant
MFRILKRLYRRFRKKKWVAFRTAAKRKRFIQLKRSTWRGDLYRWHWAWHIRRTVQKARAKPAMHARPQEARNAGRKIHVLADRFRHLRLAAKLCNRPAA

SEQ ID NO: 8315 - protein, 41 aa, Artificial Sequence
  Computer-generated peptide variant
KFRFLRKMLKRLCKRVSAMTAFVRLALKRNAEAFPLIASVM

SEQ ID NO: 8316 - protein, 27 aa, Artificial Sequence
  Computer-generated peptide variant
KFKLLRRFWRLLQTLAPIHDEKLYKRW

SEQ ID NO: 8317 - protein, 51 aa, Artificial Sequence
  Computer-generated peptide variant
KIRFLKKYFRRLKKARHAHFLRKLNKVLKEIEAYLCADWIADLKGLNPRRD

SEQ ID NO: 8318 - protein, 75 aa, Artificial Sequence
  Computer-generated peptide variant
RLRMWTRYLRMIRKWHALATLKSCDKRKTKPLARQREIRYEKLGLLLWQKLLLKARHLAKPKRVYYMQGKRAARK

SEQ ID NO: 8319 - protein, 57 aa, Artificial Sequence
  Computer-generated peptide variant
FLRYIRKIIKMLKRAARLLCHRYKRRKLALEARRLACRRVALRLAWAQDLLEQFKVA

SEQ ID NO: 8320 - protein, 27 aa, Artificial Sequence
  Computer-generated peptide variant
KFKFLKKLLKMFPHRGDLQMGRLLLIK

SEQ ID NO: 8321 - protein, 23 aa, Artificial Sequence
  Computer-generated peptide variant
RWKYFRKYFKRLPNEWLLPAALK

SEQ ID NO: 8322 - protein, 37 aa, Artificial Sequence
  Computer-generated peptide variant
LLKLWRKMIRRMKPRIRISGANSQPSDLQKKLARLAA

SEQ ID NO: 8323 - protein, 76 aa, Artificial Sequence
  Computer-generated peptide variant
LMRYFHRWMKLYKCKLNWAYYDLADKFRLNGAKKKKELKCKFQGLKLTLRLDAAKLKAHLCRLSIFRRLLELHLLF

SEQ ID NO: 8324 - protein, 41 aa, Artificial Sequence
  Computer-generated peptide variant
MLRLMCRFFRKLNTKAAAKLQPRLRRKVLMYDLKKTRWLDE

SEQ ID NO: 8325 - protein, 37 aa, Artificial Sequence
  Computer-generated peptide variant
RFKWLRKWFRKICRRKAARALLLKAKALHLYTLHVCC

SEQ ID NO: 8326 - protein, 38 aa, Artificial Sequence
  Computer-generated peptide variant
WLRMLHKLLKRLRRIWMNLRSWVLRRGEAKGACLFMRC

SEQ ID NO: 8327 - protein, 41 aa, Artificial Sequence
  Computer-generated peptide variant
KYRLFNKFFRKITKRLDLKDYAYPAAKALRAKANNKVFIKR

SEQ ID NO: 8328 - protein, 23 aa, Artificial Sequence
  Computer-generated peptide variant
WLKWLRRFIRKLSHAIIIAAARK

SEQ ID NO: 8329 - protein, 30 aa, Artificial Sequence
  Computer-generated peptide variant
KLKLWTKLIRYFRRWTIWLALRTAYARDFA

SEQ ID NO: 8330 - protein, 27 aa, Artificial Sequence
  Computer-generated peptide variant
FLRFYKKWWKWIRKLAHLLQLRLGAAK

SEQ ID NO: 8331 - protein, 67 aa, Artificial Sequence
  Computer-generated peptide variant
RFKFLRRLLKWLRNFLKLDKCKFRTKRRLRRLKVKDIEARFAKENLLSLDPSMHWAQVRKLFAHYNN

SEQ ID NO: 8332 - protein, 30 aa, Artificial Sequence
  Computer-generated peptide variant
KLRLLRKMLKFIKSWLDARYVRGLAKYIWP

SEQ ID NO: 8333 - protein, 42 aa, Artificial Sequence
  Computer-generated peptide variant
FLRLWCKFLRRFTREIALRLHKQKRLIGKAGYRKLRAVLYRV

SEQ ID NO: 8334 - protein, 37 aa, Artificial Sequence
  Computer-generated peptide variant
FLKLLKRFLRFLKRGRRMFAAAKWLKATREAYWAALN

SEQ ID NO: 8335 - protein, 30 aa, Artificial Sequence
  Computer-generated peptide variant
RMRLYRRMLRKLKRAFAAAMRRNLRSIQDN

SEQ ID NO: 8336 - protein, 21 aa, Artificial Sequence
  Computer-generated peptide variant
MLKWLQRLIRKWNKLGHLKAQ

SEQ ID NO: 8337 - protein, 21 aa, Artificial Sequence
  Computer-generated peptide variant
LLRFIKRWYKRMQSLAAKEGA

SEQ ID NO: 8338 - protein, 69 aa, Artificial Sequence
  Computer-generated peptide variant
RFKFLKKFYKRMCTKLLKCMKLANALKTPKRNAAIWELRAVLRFLKFLAKLFRILATWLLWDRRLGLNC

SEQ ID NO: 8339 - protein, 36 aa, Artificial Sequence
  Computer-generated peptide variant
RFKFIPRIWKRLKQSAADRRRCCKLAARALARHYGM

SEQ ID NO: 8340 - protein, 60 aa, Artificial Sequence
  Computer-generated peptide variant
KLRLWRKFLRRIRRYMTLAEAKCTDLRTFRAEYRLLLSDWKLPNKLKMLKLCYWKMKQRA

SEQ ID NO: 8341 - protein, 32 aa, Artificial Sequence
  Computer-generated peptide variant
LLRFMKKLIKKWPRRASALHILHKLLKLKRNP

SEQ ID NO: 8342 - protein, 43 aa, Artificial Sequence
  Computer-generated peptide variant
KFKFFTRYLRRLPKAITEAPYLRYALIQQGLLKLARHKCARHL

SEQ ID NO: 8343 - protein, 20 aa, Artificial Sequence
  Computer-generated peptide variant
LLRFMKRFLRILRHLKNPTW

SEQ ID NO: 8344 - protein, 57 aa, Artificial Sequence
  Computer-generated peptide variant
KMRLLCKFWKFLTRLLLRLRRRLVLTNEKDGLVKQAFAYAWKPSKLAAKMYVLKTLR

SEQ ID NO: 8345 - protein, 52 aa, Artificial Sequence
  Computer-generated peptide variant
KLRIFKRFFKYFKKARKAYHKARTNILRYDLVLRALRTNRNGLANLKLLFQM

SEQ ID NO: 8346 - protein, 45 aa, Artificial Sequence
  Computer-generated peptide variant
MLKLYNRFYKKWKRKTQCKLLLKREISRNLTMARARKFYKAEAEL

SEQ ID NO: 8347 - protein, 72 aa, Artificial Sequence
  Computer-generated peptide variant
RYKYMRRMMKFIKRWRRMLRIANWLARRLSVRAPMIPACKAAALTVITARKQAVTLKLRRKKSKVRARIEAH

SEQ ID NO: 8348 - protein, 39 aa, Artificial Sequence
  Computer-generated peptide variant
KLKYFKKFLRKLSQLKSILCQRLLRWLALKVALWCNGGS

SEQ ID NO: 8349 - protein, 82 aa, Artificial Sequence
  Computer-generated peptide variant
KLRFFKRFWRRIKCLKFGIKAFTTKLKWGKHWPKLHDQKAAKTLTKRRRFLTGGALALRKLVGPLLKLGARKKALFSGRADQ

SEQ ID NO: 8350 - protein, 39 aa, Artificial Sequence
  Computer-generated peptide variant
RLRLFRRFMRILRPAEFKHALFRKCARWNKLGRERAAMN

SEQ ID NO: 8351 - protein, 45 aa, Artificial Sequence
  Computer-generated peptide variant
LYRLWHKLMKRFPRLARKCLLLADKWAKEDAWLSMFRLEATATIK

SEQ ID NO: 8352 - protein, 55 aa, Artificial Sequence
  Computer-generated peptide variant
YMRLIRKFLRILKKCKAVLMAKNWKLKKRLNLTPTICRKYLKAMFSFPALALILN

SEQ ID NO: 8353 - protein, 85 aa, Artificial Sequence
  Computer-generated peptide variant
LLRLFRKWMRKLRRHLARALYPERRKRSKHSSLDASMKHLNLRWNSQKVKWRDRWKWSAKLRIIDATNSAASLKLCKRDRAEKEL

SEQ ID NO: 8354 - protein, 54 aa, Artificial Sequence
  Computer-generated peptide variant
KLKFLRKYIKLLSTPMRKPLPKKANVRLLGQRLVRSAKCKYAILKQAAFIFLQH

SEQ ID NO: 8355 - protein, 45 aa, Artificial Sequence
  Computer-generated peptide variant
RLRFLPKFFKKFCCLIPAAIASRRAFWKKKWLRKHPLLALAMHQH

SEQ ID NO: 8356 - protein, 24 aa, Artificial Sequence
  Computer-generated peptide variant
KLKLITRLFKKYKQLVLLTAKDRC

SEQ ID NO: 8357 - protein, 38 aa, Artificial Sequence
  Computer-generated peptide variant
FLKMLHKLLKKLKKADQCTAAPTRWSKNLIRIRGAIAH

SEQ ID NO: 8358 - protein, 49 aa, Artificial Sequence
  Computer-generated peptide variant
MFKYLKKYFRLLTCRLKLQRDAKLRHNRCARFVMAKRAAVAAMIRRAKA

SEQ ID NO: 8359 - protein, 23 aa, Artificial Sequence
  Computer-generated peptide variant
RYRYYHKILKRLQRMLMQLLKAF

SEQ ID NO: 8360 - protein, 24 aa, Artificial Sequence
  Computer-generated peptide variant
RLRFFKRMYRKLKRFDAHANNAAN

SEQ ID NO: 8361 - protein, 34 aa, Artificial Sequence
  Computer-generated peptide variant
LIKFLHKYIRKMRKLMWRCFKKCAQAALCLRAAI

SEQ ID NO: 8362 - protein, 25 aa, Artificial Sequence
  Computer-generated peptide variant
RWKMFPRYLRLLQSLALRRYCKKRA

SEQ ID NO: 8363 - protein, 38 aa, Artificial Sequence
  Computer-generated peptide variant
FFRYLKKLFRWYKKRAKRETLALNLFYLSKNFRLLKEW

SEQ ID NO: 8364 - protein, 88 aa, Artificial Sequence
  Computer-generated peptide variant
KLKLLRKMFRLLKRPSRRVLCPPSDRRAKTAPSHLAAMQAQRWDGLVVTPGRKAYMAKNARKALNLALAHKKLARKTVIFSVALPLLT

SEQ ID NO: 8365 - protein, 36 aa, Artificial Sequence
  Computer-generated peptide variant
RFRFWKKFFRLYKTLNLRRACAKADALRNHKAWLFK

SEQ ID NO: 8366 - protein, 70 aa, Artificial Sequence
  Computer-generated peptide variant
KFKLISKWFRLLKQAKLAKQRFQELKEPAKKQKTPVYRKKKFFVKWRMTKMGRLYFKVAEPLAALKARAC

SEQ ID NO: 8367 - protein, 30 aa, Artificial Sequence
  Computer-generated peptide variant
FLRFYKRLWKLFKCTLGKARRLKNGHRLLL

SEQ ID NO: 8368 - protein, 90 aa, Artificial Sequence
  Computer-generated peptide variant
MYRIFRKMLKWYTCLAAIHPADCEAELMPPELAKSIAKRQALDKAKWRAHAYALARAKDAKKHGKGALCRLLANFKTRLLQRAKELMKWR

SEQ ID NO: 8369 - protein, 84 aa, Artificial Sequence
  Computer-generated peptide variant
KIKMYRKLIKRLTKKPNDRMILEQWALFKSRKEKIGQLALPKKRRQLMAFRKKKRIYLFSQYLKKAKKRAAMMLAMLAALLDVL

SEQ ID NO: 8370 - protein, 39 aa, Artificial Sequence
  Computer-generated peptide variant
KLRIWTRLIRRLRNLYRAAQYQKAKAFANYKWKLKAPYD

SEQ ID NO: 8371 - protein, 36 aa, Artificial Sequence
  Computer-generated peptide variant
WLRMLPKFLKRLHKGAKALKAEKRLICRNKKAMIAK

SEQ ID NO: 8372 - protein, 87 aa, Artificial Sequence
  Computer-generated peptide variant
RFKWLNKLFRKFSRPKRSGFFVKKLAKRVKDALEARHFLTRRYVSSIRNKLMGRRLQVTAQRRAGFRRRATAAKRQDPKSVAWLLLA

SEQ ID NO: 8373 - protein, 34 aa, Artificial Sequence
  Computer-generated peptide variant
WLKMLNKWLRKYKKDCPAHAQHLSKCKRLLDKKH

SEQ ID NO: 8374 - protein, 33 aa, Artificial Sequence
  Computer-generated peptide variant
MFKYLNRFLKLLRKRRRHAAAFQGRILKLMWKP

SEQ ID NO: 8375 - protein, 64 aa, Artificial Sequence
  Computer-generated peptide variant
RWKWFRKFLRLMKKTKGWRLAKYARTAKARAAKRRALAQGKAVLMCPHRHYFEQTLLRQFLKTH

SEQ ID NO: 8376 - protein, 34 aa, Artificial Sequence
  Computer-generated peptide variant
KLKFYKKWLRFFKRRLWEANKSIQLKLRCRAAWL

SEQ ID NO: 8377 - protein, 100 aa, Artificial Sequence
  Computer-generated peptide variant
KLRIFQRLMRFLKKMNMAPRRRAKTAGYPAGRAHKLALAHKRKAKGRCLLFELTVSRIVLYLRLRLLGFTESANATIYKSDRAKRCMLAFTLRAIEKTAA

SEQ ID NO: 8378 - protein, 33 aa, Artificial Sequence
  Computer-generated peptide variant
RMKLLKRLLRFWKRGRPQCLCALHLDVAYGRRR

SEQ ID NO: 8379 - protein, 83 aa, Artificial Sequence
  Computer-generated peptide variant
RWRFYTKLFRKLTCNKLFRIYAMMVWAALKNAIRVGEPKAAVLLQTSRLAGALQNKDAKIVKPFKKAKAIRKKKIRRACRYLR

SEQ ID NO: 8380 - protein, 63 aa, Artificial Sequence
  Computer-generated peptide variant
ILRLFKKLWRWLKRFKMEHRRMEACLYGFKQRRKKLESGARALNLRLGAPAAKKDADNEASRA

SEQ ID NO: 8381 - protein, 24 aa, Artificial Sequence
  Computer-generated peptide variant
KLRFFRRFWKKLSRLLTIYAAQAR

SEQ ID NO: 8382 - protein, 21 aa, Artificial Sequence
  Computer-generated peptide variant
YMKLLNRWMKKIKKLHLYHRA

SEQ ID NO: 8383 - protein, 42 aa, Artificial Sequence
  Computer-generated peptide variant
LWRWFQRLLRLLCKVRLMMANARKLKRLNHNKIMALLHKCKP

SEQ ID NO: 8384 - protein, 47 aa, Artificial Sequence
  Computer-generated peptide variant
KLKLLNRWLKRLRTMRLTWYAFAIRRKLRAEATICGRDAFKKREREA

SEQ ID NO: 8385 - protein, 25 aa, Artificial Sequence
  Computer-generated peptide variant
RWRMLRKLLKRLCNDAFLLQACFKF

SEQ ID NO: 8386 - protein, 69 aa, Artificial Sequence
  Computer-generated peptide variant
FIRWLHKFLRYMRRRLLARLAKAKKCLYTIWRKHSPYINADYMMKRLKAWKTLQLWRMADCVYRLRRAL

SEQ ID NO: 8387 - protein, 34 aa, Artificial Sequence
  Computer-generated peptide variant
LLRFMNRLLRLFRNTLLLDNLRSKVLKEKAVCRG

SEQ ID NO: 8388 - protein, 36 aa, Artificial Sequence
  Computer-generated peptide variant
MMRLMPKMYRRYRRLLALAHLFKYSLRKVYLFRQYK

SEQ ID NO: 8389 - protein, 26 aa, Artificial Sequence
  Computer-generated peptide variant
KFKLLHKLFRRYKPSLLVKALKSKDL

SEQ ID NO: 8390 - protein, 28 aa, Artificial Sequence
  Computer-generated peptide variant
LYKMLKKLWRKLPCAGNKVEAKADLGKR

SEQ ID NO: 8391 - protein, 59 aa, Artificial Sequence
  Computer-generated peptide variant
RLKYINRWLRWLNRGYAQLRKNDCLFRVVGKKRIARIALLCLEKQLRDLAAERLPAIYR

SEQ ID NO: 8392 - protein, 40 aa, Artificial Sequence
  Computer-generated peptide variant
LWRYLCRLLRRYQRRAYQLHPGLRYKLAIVNRALVLATRQ

SEQ ID NO: 8393 - protein, 80 aa, Artificial Sequence
  Computer-generated peptide variant
KLRLFKKYIKRLKKCAEGARMSRGTLFLRLRKILDDFRRQDRRPTQNRLLARPRGQMAKFLCTLHARNRPKADALTCRDM

SEQ ID NO: 8394 - protein, 27 aa, Artificial Sequence
  Computer-generated peptide variant
RLKFYKRLLKKFTKVMGNAFAARSARH

SEQ ID NO: 8395 - protein, 77 aa, Artificial Sequence
  Computer-generated peptide variant
KLRWWKKLLKKLNQRYLAKPNKVRVVSKLGQCWLERSQLKHLLRKRAQTKRKLYACLRFVTRTMCRSVAYYARRRAC

SEQ ID NO: 8396 - protein, 20 aa, Artificial Sequence
  Computer-generated peptide variant
KFRLFPRYLRKMQRSLAAPL

SEQ ID NO: 8397 - protein, 30 aa, Artificial Sequence
  Computer-generated peptide variant
RFKLLQKLLRFLQRKWRGAGTHPLRVRRGL

SEQ ID NO: 8398 - protein, 21 aa, Artificial Sequence
  Computer-generated peptide variant
MLRLLRKMYKKMHTALAGHWL

SEQ ID NO: 8399 - protein, 41 aa, Artificial Sequence
  Computer-generated peptide variant
YFRMLTKMMKYYHNRDAGAAKRRKMLMAKRKRLKLATREAA

SEQ ID NO: 8400 - protein, 72 aa, Artificial Sequence
  Computer-generated peptide variant
KLRLLSRFWRKLKKNVQNAYPRTRADKGKFNAALKITRQHNCFDKAKALGEFALILLKLRQKAAKTAKLRLR

SEQ ID NO: 8401 - protein, 25 aa, Artificial Sequence
  Computer-generated peptide variant
LLKLWKRLFRRFKTVANGLRSNRTC

SEQ ID NO: 8402 - protein, 91 aa, Artificial Sequence
  Computer-generated peptide variant
LLKFLSKYWRKYKTMAGQKKKRPLWLGALTFKKFHKTDKNDWRLQRKKAAILWATKALAARLDAILTRANIHLRKGAHSMLAKERSRAWTR

SEQ ID NO: 8403 - protein, 60 aa, Artificial Sequence
  Computer-generated peptide variant
RFKFWPKLMRLYKPKLKKRNMFRCRKLGFLAKLKHYILGSFPPRSLLANPHLAKKRLRIK

SEQ ID NO: 8404 - protein, 57 aa, Artificial Sequence
  Computer-generated peptide variant
LLKFIKKWMKLFRRQNALPKKLYCCLHCHKLAQRKMGLQTKFQGLLLAALRFDKRLW

SEQ ID NO: 8405 - protein, 20 aa, Artificial Sequence
  Computer-generated peptide variant
KLKLLSRMLKLFSRSSAGTG

SEQ ID NO: 8406 - protein, 39 aa, Artificial Sequence
  Computer-generated peptide variant
KYKIISRYFRMINKLAKMRGLMLHRNARKARHLLASRLL

SEQ ID NO: 8407 - protein, 52 aa, Artificial Sequence
  Computer-generated peptide variant
YFKIYKRFYRRYKRRALKAVTALYILPGDIAARPKDTLGISLLAKHRALYKL

SEQ ID NO: 8408 - protein, 78 aa, Artificial Sequence
  Computer-generated peptide variant
KLRWIRKYLKKWTRFLAYNLPAQGSKLWAKRYKRDDAKKFRRNYNIRAYAERTRQRCRCLASKHAMYLWIALARGALR

SEQ ID NO: 8409 - protein, 24 aa, Artificial Sequence
  Computer-generated peptide variant
RFKFYRKMLKRMSKLGLARLAINV

SEQ ID NO: 8410 - protein, 27 aa, Artificial Sequence
  Computer-generated peptide variant
RMKFFRKLYRKWQCQLTVRLGALAKAK

SEQ ID NO: 8411 - protein, 98 aa, Artificial Sequence
  Computer-generated peptide variant
KLKLLRKFFKRLRPETDLMCLLARAYLLSVAKFINHLALGILANQYFRLKAKDCMMRRLWLSYAAKNCKHRYRAPLRIRSRGAICESCTLALLEATKK

SEQ ID NO: 8412 - protein, 41 aa, Artificial Sequence
  Computer-generated peptide variant
IYRWLRKYLRFLRKAKCLKRGAWLQRLARTDRPACAWMFKG

SEQ ID NO: 8413 - protein, 72 aa, Artificial Sequence
  Computer-generated peptide variant
KLRWMRRLLRLWKRKAKEATGMKMANYRRHLRPKKRMCMRAVTQTANAIAEARWGFPPAKLLVLKKAKSVKC

SEQ ID NO: 8414 - protein, 27 aa, Artificial Sequence
  Computer-generated peptide variant
LLKLMKKFLKRMRKAPDTTLTCKAIRG

SEQ ID NO: 8415 - protein, 58 aa, Artificial Sequence
  Computer-generated peptide variant
RYKFLSRLLRWFKKAAANLLFKLVSMREKIALRAFIRLWARRKKFRAGGWDICAAMRA

SEQ ID NO: 8416 - protein, 36 aa, Artificial Sequence
  Computer-generated peptide variant
MYKLLNKLLRRMRKRHPASVKCAKLWNCASHILKWK

SEQ ID NO: 8417 - protein, 38 aa, Artificial Sequence
  Computer-generated peptide variant
ILKFYKKLLRLWQKADLLLFAYLKCTKRKRVQKTKRSE

SEQ ID NO: 8418 - protein, 41 aa, Artificial Sequence
  Computer-generated peptide variant
YIKILNRLWKLLKKLLHSVRCHAKAMGAAARQRRLECAAWC

SEQ ID NO: 8419 - protein, 32 aa, Artificial Sequence
  Computer-generated peptide variant
KLKLWKRYFKKMRQCLLDKCIRANRNAPTAKA

SEQ ID NO: 8420 - protein, 23 aa, Artificial Sequence
  Computer-generated peptide variant
KWKLFRRFLKFLKSALRVILAQR

SEQ ID NO: 8421 - protein, 54 aa, Artificial Sequence
  Computer-generated peptide variant
MLRIMSKMFKRLPRKSFWISRLLYDTKAKLLLLKELKKRRCHILRYNAARCYAK

SEQ ID NO: 8422 - protein, 59 aa, Artificial Sequence
  Computer-generated peptide variant
RFKLLRRILRKMKQPQAKHQRMKVARKRCRERLVPFTDKLASLLRPRANCAKHLLRLQA

SEQ ID NO: 8423 - protein, 29 aa, Artificial Sequence
  Computer-generated peptide variant
WFKFLKKFLRKLHRSARAKYTAAPRSNAR

SEQ ID NO: 8424 - protein, 21 aa, Artificial Sequence
  Computer-generated peptide variant
RLKYWRRLFKKFKHMTLCALL

SEQ ID NO: 8425 - protein, 47 aa, Artificial Sequence
  Computer-generated peptide variant
FIRLLSKLMKRLHCHRELAGRRFMWLRSRARRKMKLAAWELEALIAR

SEQ ID NO: 8426 - protein, 53 aa, Artificial Sequence
  Computer-generated peptide variant
MLKLFHRFFKFFRRALLKNRLTAAVASLAARDFKDRLKVLASVKLKVCFHLEA

SEQ ID NO: 8427 - protein, 47 aa, Artificial Sequence
  Computer-generated peptide variant
YLKLISRIFRLYKTAWADHIKLIRKKALLMLARRARTAYQTRQWSDR

SEQ ID NO: 8428 - protein, 24 aa, Artificial Sequence
  Computer-generated peptide variant
IFKMLRKYYKRLKRLLAARQKKAA

SEQ ID NO: 8429 - protein, 43 aa, Artificial Sequence
  Computer-generated peptide variant
RLRFIKKFIKRLKRKKSWFRRYASASADGCLAYARLPIACVSK

SEQ ID NO: 8430 - protein, 23 aa, Artificial Sequence
  Computer-generated peptide variant
KLKLFKKLLKLYKKIRLKKLMLQ

SEQ ID NO: 8431 - protein, 27 aa, Artificial Sequence
  Computer-generated peptide variant
RLKLFRKLFKLIPPANKQDRLDAKPKW

SEQ ID NO: 8432 - protein, 28 aa, Artificial Sequence
  Computer-generated peptide variant
YLRILTKFLKKMRKLKRHCLEAKDYILY

SEQ ID NO: 8433 - protein, 35 aa, Artificial Sequence
  Computer-generated peptide variant
RLKMLKKLLRLMRPDLGCHLNLRLRCLTRTWLYPV

SEQ ID NO: 8434 - protein, 24 aa, Artificial Sequence
  Computer-generated peptide variant
LFRLMCKLMKLLRTYAQRRKLLHQ

SEQ ID NO: 8435 - protein, 56 aa, Artificial Sequence
  Computer-generated peptide variant
RLKLLRRLWKKMSKLMLWRAKAHLGQFRMKAKSQRAWASMMARVKANVNWNRAKKL

SEQ ID NO: 8436 - protein, 48 aa, Artificial Sequence
  Computer-generated peptide variant
YMRWLNRLLRKITRLAKPCELVRRNHLFLRKKQEVMLKRLAGHQLAKI

SEQ ID NO: 8437 - protein, 28 aa, Artificial Sequence
  Computer-generated peptide variant
YWRLFRRFLKKLKRLLTAAKTYGAQRKT

SEQ ID NO: 8438 - protein, 46 aa, Artificial Sequence
  Computer-generated peptide variant
LFRFLNKYYRKWPRKRLTLYAMWRLAFRYFMYKALRQKKAALNSKC

SEQ ID NO: 8439 - protein, 38 aa, Artificial Sequence
  Computer-generated peptide variant
RYRFFKRILKILPSRFKVLNPARARLPKALRATDKLDA

SEQ ID NO: 8440 - protein, 29 aa, Artificial Sequence
  Computer-generated peptide variant
LWRMLNRLFKRFQRLLRRIDLEKWVKIAQ

SEQ ID NO: 8441 - protein, 52 aa, Artificial Sequence
  Computer-generated peptide variant
WMKLINKFYKRYNKSALLLRAATPWDRLTKLRKIAWRKVHLLRRHQNLRKML

SEQ ID NO: 8442 - protein, 59 aa, Artificial Sequence
  Computer-generated peptide variant
YLRFWHKYLKMFPRDDKWRMNPALRSMKNALIARAMVLKEKWARACLKAPLLSALRKKC

SEQ ID NO: 8443 - protein, 58 aa, Artificial Sequence
  Computer-generated peptide variant
LWRLFKRLWKRIKRHELKGGAKKRVRAAKQNSYHANDKNKWTKDWWLLQLALLCCAKK

SEQ ID NO: 8444 - protein, 47 aa, Artificial Sequence
  Computer-generated peptide variant
RYRLFSRFLKRMRTCAVQLKKPAAPLARTAALGCARLERRVYVWAPA

SEQ ID NO: 8445 - protein, 36 aa, Artificial Sequence
  Computer-generated peptide variant
KLRFLRKIIKRLTKDAALLGFAWAAYANWVVREHRL

SEQ ID NO: 8446 - protein, 61 aa, Artificial Sequence
  Computer-generated peptide variant
MYKLLSKLFKYWSRSLVRMVAWQAAARMLRYKLRPDAAIRKKRAKQGKAAKHNLMLEIWRL

SEQ ID NO: 8447 - protein, 33 aa, Artificial Sequence
  Computer-generated peptide variant
RYKLFRRMLKRLTPKCLMLELTAEPLLFLLFIK

SEQ ID NO: 8448 - protein, 66 aa, Artificial Sequence
  Computer-generated peptide variant
RLKILCKFYRKYQRMLALKDRDKLASLQPWLKKHAKWHRALIFKQAGNRTDLKKAKNKYRLCPNIK

SEQ ID NO: 8449 - protein, 57 aa, Artificial Sequence
  Computer-generated peptide variant
RIKLLHRMWKRLHKNARCTFHARLKEPKWAWDLRLTAYKRTARCRAILAFINADLNL

SEQ ID NO: 8450 - protein, 61 aa, Artificial Sequence
  Computer-generated peptide variant
RLRLLRRMIKKIHHLPDSNGERLGGPAALLKKRKLPNDLVPAQHLARAWRRAHACAAKWEN

SEQ ID NO: 8451 - protein, 39 aa, Artificial Sequence
  Computer-generated peptide variant
LFRLYRKFFRKMRPWLPRNLKKSAILANCRAALGAEGNL

SEQ ID NO: 8452 - protein, 23 aa, Artificial Sequence
  Computer-generated peptide variant
FFRLYRKLMKLFPKQHLLPQRKL

SEQ ID NO: 8453 - protein, 29 aa, Artificial Sequence
  Computer-generated peptide variant
WFKLWKKFLRLLPRTCQVEFLGKARLRLK

SEQ ID NO: 8454 - protein, 28 aa, Artificial Sequence
  Computer-generated peptide variant
RMRLLRRLLRLFRKHQQSAKKRACSIAP

SEQ ID NO: 8455 - protein, 30 aa, Artificial Sequence
  Computer-generated peptide variant
LIKLLRKLLKLWTCLKQARFTAKKKFQKRQ

SEQ ID NO: 8456 - protein, 53 aa, Artificial Sequence
  Computer-generated peptide variant
RIRWMNKYFKRIKRYKAAKAKNRACARLMLEAWHWETFALTWKSLLAFKLYAR

SEQ ID NO: 8457 - protein, 33 aa, Artificial Sequence
  Computer-generated peptide variant
FMKLLKKLWKKIKSAMNLLWARRIDLRKDAVLH

SEQ ID NO: 8458 - protein, 34 aa, Artificial Sequence
  Computer-generated peptide variant
FYRFLRKMLKLLKSNRQAATIARKLWSHASAKDW

SEQ ID NO: 8459 - protein, 54 aa, Artificial Sequence
  Computer-generated peptide variant
LYKMLKKMLRKLKKRIRLLLMTQRKYATMALMPTLAKYILTKAFYDSRKGRYFF

SEQ ID NO: 8460 - protein, 54 aa, Artificial Sequence
  Computer-generated peptide variant
MLRYLKRLMKKYKRILADLKYLHLRIISRARLSTKKARHLHKAVLNLKLIKFRL

SEQ ID NO: 8461 - protein, 30 aa, Artificial Sequence
  Computer-generated peptide variant
KYRMWKKWWRLLCRTAAKKAAAKPCVHPTK

SEQ ID NO: 8462 - protein, 52 aa, Artificial Sequence
  Computer-generated peptide variant
RMKMWKRFYKKWQKAIRLKRERKLAAELWTLLAATAAVGWLKLNGILLQHTC

SEQ ID NO: 8463 - protein, 60 aa, Artificial Sequence
  Computer-generated peptide variant
KIRFFKKMLRWLQRYCRYCLRTRDLRRQALVAKDKLWKLADFMKAQKHVAVAKLQKYPPL

SEQ ID NO: 8464 - protein, 79 aa, Artificial Sequence
  Computer-generated peptide variant
RLRLFHRFLRKWKNAHFLLAGSLLAHGAVRLDCLAASNIMKKDCWMRQKRLRTAAQSELKRIRLCRAGLSVLYRAKELK

SEQ ID NO: 8465 - protein, 39 aa, Artificial Sequence
  Computer-generated peptide variant
RIRLFKRWYRRFKRARPTLRNRPYALARVLAAAYACETW

SEQ ID NO: 8466 - protein, 70 aa, Artificial Sequence
  Computer-generated peptide variant
RLRLIKRLMRRLPKFAMNYIEEKMCALYAYRWHDWRANKLKFSACKELKCLASRTCRAAVGLYRRARKAC

SEQ ID NO: 8467 - protein, 39 aa, Artificial Sequence
  Computer-generated peptide variant
LFRFLRKMFKLLSRRVAWRRPYKCKKLAACKYYMSLNPL

SEQ ID NO: 8468 - protein, 55 aa, Artificial Sequence
  Computer-generated peptide variant
MFRLLHKFMRKMKRTAKLDAVLKGKRSYTMHCKLCTMAPKFKRMILKALKKKALP

SEQ ID NO: 8469 - protein, 76 aa, Artificial Sequence
  Computer-generated peptide variant
RMKLYKRMWRLYKCWERLAYADHGEYKRKAARTTACQLNRRAREFQKKRKFEKKAGPALFAIIRKLKLKTYKAELT

SEQ ID NO: 8470 - protein, 60 aa, Artificial Sequence
  Computer-generated peptide variant
RIKYLSKFFRKFKRMMRLPSLKFDRLQRKKKLCQKAWAWRWWKTRATADTLERLALRDLD

SEQ ID NO: 8471 - protein, 29 aa, Artificial Sequence
  Computer-generated peptide variant
RFKMLRRFYKKFRHALQDRVASHAAAAQQ

SEQ ID NO: 8472 - protein, 48 aa, Artificial Sequence
  Computer-generated peptide variant
YLKIFKRFLRFMPKMHLAVRNRRCLAFADWSARVAKAAKRATYAYPLL

SEQ ID NO: 8473 - protein, 42 aa, Artificial Sequence
  Computer-generated peptide variant
LLRWLKRILRKIRNAAKDRPYALPHVVKATGKVHKRKEFGAR

SEQ ID NO: 8474 - protein, 47 aa, Artificial Sequence
  Computer-generated peptide variant
RIKLWSKYFRFWQKSLAPRLKMLKASCRLLLPKLCAVLRMRIYGALK

SEQ ID NO: 8475 - protein, 56 aa, Artificial Sequence
  Computer-generated peptide variant
KLRLFKKFFRKFCRKHSYRRDFFDALFAASRSINILNSRALAKTKLGRQAARALES

SEQ ID NO: 8476 - protein, 58 aa, Artificial Sequence
  Computer-generated peptide variant
RFKMMTRYLRKLRTERELRKRAAAGLATKYWDRAIRLRAHSPWVAEALTVLAYAFKHH

SEQ ID NO: 8477 - protein, 70 aa, Artificial Sequence
  Computer-generated peptide variant
YLRFLSKIWRKLQRLPKCQSRDPAREAKAARAAKRLRRYMSLMQFEALIKAKKDFARRPLFGAAIARKRK

SEQ ID NO: 8478 - protein, 82 aa, Artificial Sequence
  Computer-generated peptide variant
FFRFLKRLIRLFTTTALLAWWLLRPDHRNQFKRLRLHRRACRGRPGWDPDRNVMLAAARAAERATAAWCSARRLKGYKWLRR

SEQ ID NO: 8479 - protein, 23 aa, Artificial Sequence
  Computer-generated peptide variant
MLRLLKRMFKFLSRACLAMVHER

SEQ ID NO: 8480 - protein, 29 aa, Artificial Sequence
  Computer-generated peptide variant
RYRWLKRLFKRLKSIKKATWVQLALTKQA

SEQ ID NO: 8481 - protein, 58 aa, Artificial Sequence
  Computer-generated peptide variant
MLKYLKKMLRRLHKKLLKFGKLEAGIMARANREPALAAQLYRNRFNMARHNQEMVRFK

SEQ ID NO: 8482 - protein, 31 aa, Artificial Sequence
  Computer-generated peptide variant
LWKWLKKFLKKWKKEAFVRLWATAPFLAAHK

SEQ ID NO: 8483 - protein, 75 aa, Artificial Sequence
  Computer-generated peptide variant
KMKWLSRYFKRLKRVKRTDTQKSLNARPLLPPATAKACIKKREAKDNCANRCEAKLMLLLRKLLLWAWNQPEKRV

SEQ ID NO: 8484 - protein, 79 aa, Artificial Sequence
  Computer-generated peptide variant
YLKLIKRWIKFMRQGMLENKKYAYARANDVKLFRGLKEYAYKAEYKLKRMIKARLKKAKRLFLWQLLTQMKAKKPKKPG

SEQ ID NO: 8485 - protein, 22 aa, Artificial Sequence
  Computer-generated peptide variant
FFRFLKKLLRRLKHIIAKEAIR

SEQ ID NO: 8486 - protein, 59 aa, Artificial Sequence
  Computer-generated peptide variant
YYKLIRKYLRFYNRKLKLDPVKWTYHKPYALKYMRCLKKKSQLKLKAARYCILCAAPKK

SEQ ID NO: 8487 - protein, 78 aa, Artificial Sequence
  Computer-generated peptide variant
RMKLYPRLLKKIQSFNSARDHGARPKPNIARKRALTNSKEKLYIIAKKAASDARRPLELFTRPDRAAAIWKRARAQPL

SEQ ID NO: 8488 - protein, 46 aa, Artificial Sequence
  Computer-generated peptide variant
FLRLFRKILRRMRRGINLDRDHNHLLAAHRSLALKFAFRRNDLAGL

SEQ ID NO: 8489 - protein, 81 aa, Artificial Sequence
  Computer-generated peptide variant
RFRLWPKLYKIISRADNLHANRLKFLGGGSKFTPRKKSARLIYAKIRPKLCKDAWLLLRAKAKRSAYRAVALRLTGDKYWD

SEQ ID NO: 8490 - protein, 61 aa, Artificial Sequence
  Computer-generated peptide variant
KLRWLKRLYKRWKCLALATLLLAACKVDCVLIQMKRFLKLKKDEQFPWNCGDIRRDAKRAV

SEQ ID NO: 8491 - protein, 33 aa, Artificial Sequence
  Computer-generated peptide variant
YYKLWQKLYKKFQKNLGAAKDREHKLRYLAFKL

SEQ ID NO: 8492 - protein, 58 aa, Artificial Sequence
  Computer-generated peptide variant
FLKMLTRMIRRLQQKQRKLGAACFSTMLRACRKQKKVLAYLMELRARFAAQEMWLRSA

SEQ ID NO: 8493 - protein, 20 aa, Artificial Sequence
  Computer-generated peptide variant
FLRWLQRLMKLLTKDHCPRK

SEQ ID NO: 8494 - protein, 55 aa, Artificial Sequence
  Computer-generated peptide variant
YFRFLKRLFRKMKPKEVKRDRIALTWKGLEPRAMARARYAFRMQTRSLMAIRAAK

SEQ ID NO: 8495 - protein, 50 aa, Artificial Sequence
  Computer-generated peptide variant
RFRLYQRLMKRMRCAFRKAAKLRANNLRIDARMAVIGLLDAHKVTNSARR

SEQ ID NO: 8496 - protein, 40 aa, Artificial Sequence
  Computer-generated peptide variant
MYKIIRKLLRMFKHAGHLGVAHKLKLHLYLRAQRATSLMK

SEQ ID NO: 8497 - protein, 21 aa, Artificial Sequence
  Computer-generated peptide variant
LFRWLKRLWRWFKKAQRASMC

SEQ ID NO: 8498 - protein, 35 aa, Artificial Sequence
  Computer-generated peptide variant
YWKLMKRIWRLLRRKLSVDASRNKQLCFKLHKLAM

SEQ ID NO: 8499 - protein, 33 aa, Artificial Sequence
  Computer-generated peptide variant
FLRFFSRIFRRYKKRRANDMRLAYLLALAGWHK

SEQ ID NO: 8500 - protein, 38 aa, Artificial Sequence
  Computer-generated peptide variant
MLRLLHKFLRFYKKMYLKDYNPWRLKARAEANPRPLKL

SEQ ID NO: 8501 - protein, 36 aa, Artificial Sequence
  Computer-generated peptide variant
RMRLWRKYLRFMPRKAMLIRALKAADRALKKTNCYW

SEQ ID NO: 8502 - protein, 87 aa, Artificial Sequence
  Computer-generated peptide variant
LLKFMRKMFRLWKQFHYKVRAFPTFAARLEAWLAARMYHAAEKAFRRKGANAQVNRCTLEARLAGAYLAMARLLYGHAKRYPLWKQK

SEQ ID NO: 8503 - protein, 58 aa, Artificial Sequence
  Computer-generated peptide variant
KFKFWKRLMRKLHRKRAPDWRLAKMRLWRCVACTASNALFMTAKKWVLLATCPSLLRV

SEQ ID NO: 8504 - protein, 35 aa, Artificial Sequence
  Computer-generated peptide variant
FLRYYKKYWKKLSKAAWLNYLLWVFAARSVKKAPR

SEQ ID NO: 8505 - protein, 78 aa, Artificial Sequence
  Computer-generated peptide variant
LLRMIKKLMRYWTHMNAKFLPAAALHKRLEGSQLLTHKVTLLGYACKKRKLLREKAGWKCRMRHALGLLRGAHARMPI

SEQ ID NO: 8506 - protein, 36 aa, Artificial Sequence
  Computer-generated peptide variant
ILKFLHKLLKFLKKKKYAREQLVGSKLAAWWGIRPN

SEQ ID NO: 8507 - protein, 51 aa, Artificial Sequence
  Computer-generated peptide variant
RLKLWTRYMRIIKTLYLRLLRCAVRAKETKKKKKYAPPLLKLLEIRKKFTS

SEQ ID NO: 8508 - protein, 31 aa, Artificial Sequence
  Computer-generated peptide variant
KLKYLRRYIKRLKKPLARPKAHVHHLKLATR

SEQ ID NO: 8509 - protein, 54 aa, Artificial Sequence
  Computer-generated peptide variant
RLKWWKRLFKLICKKAEAGDLLLLWPPKWPARMDAKQGAKADQCRRARVMKHRY

SEQ ID NO: 8510 - protein, 21 aa, Artificial Sequence
  Computer-generated peptide variant
FFRWLKRYFRLMQKLLNKARM

SEQ ID NO: 8511 - protein, 39 aa, Artificial Sequence
  Computer-generated peptide variant
KLRLMCKFLRFLKTRYLPYAALRRRNDKLNVRAMAKDMG

SEQ ID NO: 8512 - protein, 58 aa, Artificial Sequence
  Computer-generated peptide variant
FFRILRKMIKKMKPAWKDKKLQYKLCHLIRRYQHLARRHSAAAAAYYAKRKYSWAHAM

SEQ ID NO: 8513 - protein, 21 aa, Artificial Sequence
  Computer-generated peptide variant
KLKLFNRFLRFLNKWLRKLRD

SEQ ID NO: 8514 - protein, 68 aa, Artificial Sequence
  Computer-generated peptide variant
LLKYMKKLFRYYTPLAFENLASRERRNFVLALCCSLRRLQLAKYMLKRKKWSLKLAKGCANLKPVRMQ

SEQ ID NO: 8515 - protein, 85 aa, Artificial Sequence
  Computer-generated peptide variant
RFRFMRRLFKFWKKHRKNVRLAQNLSDLRLRLRRKRLNARLRPPKKRYAHWKLNLLARHPKWAYQRTMSPLKSPCFLADSTKAVI

SEQ ID NO: 8516 - protein, 46 aa, Artificial Sequence
  Computer-generated peptide variant
KLRLLKKFLKFFRPADKGDKGMALVIDLSFAAMIKRALKHMLCAAR

SEQ ID NO: 8517 - protein, 23 aa, Artificial Sequence
  Computer-generated peptide variant
KLKLWRKLLRRFHKAPDGVARFV

SEQ ID NO: 8518 - protein, 64 aa, Artificial Sequence
  Computer-generated peptide variant
LIRLIRKFFKRWNKIGKLRKTEAKLKYRLRANMRRNCKLMKLYKWRVNALMLLTPRDAQSIQAK

SEQ ID NO: 8519 - protein, 26 aa, Artificial Sequence
  Computer-generated peptide variant
RMRLFSRLFKRFSRELAEARLTAPAT

SEQ ID NO: 8520 - protein, 48 aa, Artificial Sequence
  Computer-generated peptide variant
LIRMYKRLFKKFTPKHRAAVMDRQLAKQALWAKRLKKYKLLWAQFASM

SEQ ID NO: 8521 - protein, 57 aa, Artificial Sequence
  Computer-generated peptide variant
KLRLWTRLFRKYRKAGLKKDRDCKLWACARACRKADSIWKTRLQLLKRGYILVRRLY

SEQ ID NO: 8522 - protein, 40 aa, Artificial Sequence
  Computer-generated peptide variant
RMKFLTRIIKLLQKKGNSGKKLARYAADLLVDATKLTLFM

SEQ ID NO: 8523 - protein, 26 aa, Artificial Sequence
  Computer-generated peptide variant
RIKLFKRFLKLIKQAARFAKQALFRA

SEQ ID NO: 8524 - protein, 20 aa, Artificial Sequence
  Computer-generated peptide variant
WLKWLNRYLKLIKQAKWFKY

SEQ ID NO: 8525 - protein, 20 aa, Artificial Sequence
  Computer-generated peptide variant
KIKWICRLIKRLQKALGPLQ

SEQ ID NO: 8526 - protein, 52 aa, Artificial Sequence
  Computer-generated peptide variant
WLRFYRKLLKLIQKRIAKPKLATKVARRCLLPPFRWCKTLRFLLLLAAAAHR

SEQ ID NO: 8527 - protein, 37 aa, Artificial Sequence
  Computer-generated peptide variant
KFRLYNKLLRKFPQITKKIPALHLARLERRKVSALRK

SEQ ID NO: 8528 - protein, 22 aa, Artificial Sequence
  Computer-generated peptide variant
LFRIYKRWWRRLNRKYNAAARA

SEQ ID NO: 8529 - protein, 66 aa, Artificial Sequence
  Computer-generated peptide variant
RFRFLKKLWKRMKRKLRNRCLAFEKSRATLARRKAIMRREKRAANLWSPAAAIMKQNRLDARLMRY

SEQ ID NO: 8530 - protein, 63 aa, Artificial Sequence
  Computer-generated peptide variant
FYRYWKRLFKKYRRTYRAAEFPASRHTPHSFINAKRSRLRFLAAWAKKQLKKKNRLALIALLR

SEQ ID NO: 8531 - protein, 25 aa, Artificial Sequence
  Computer-generated peptide variant
RMKILKRMLKRLTPLFYKDKLLLKY

SEQ ID NO: 8532 - protein, 61 aa, Artificial Sequence
  Computer-generated peptide variant
KFKLFQRLLKRMKKAQNALRAKLARDANRKEREAKLILKKIYRYDSDKRKLRRNHCLAFCL

SEQ ID NO: 8533 - protein, 65 aa, Artificial Sequence
  Computer-generated peptide variant
MYRLFKRLWKKIKKSKFFQNRRWAALAVAKHNRNRLRYMKLVHIMRPTANRSLAGLLRKLFWAPA

SEQ ID NO: 8534 - protein, 45 aa, Artificial Sequence
  Computer-generated peptide variant
RFRWFRKMLRKYKKSAHLWVRKKAHLDAEMLSHAAGSAAYFLKHR

SEQ ID NO: 8535 - protein, 65 aa, Artificial Sequence
  Computer-generated peptide variant
YLKIFTRWLKKWRKGKALLGLNALLLLRPDANRKFEPSFIACKLKKAATKCKWKPLLHVKAKRKN

SEQ ID NO: 8536 - protein, 51 aa, Artificial Sequence
  Computer-generated peptide variant
KLRWMPKLLKILRKLAHEKHAAKFRDLIQKPRAWKWARKLLNCFRRKVHKF

SEQ ID NO: 8537 - protein, 55 aa, Artificial Sequence
  Computer-generated peptide variant
RLKFYCRILKLFRPSRQTAGLRKGRKNHQFFLSKKRLLTRNLRKRPVQLRLPGLL

SEQ ID NO: 8538 - protein, 38 aa, Artificial Sequence
  Computer-generated peptide variant
RLRLLTRLIRKIRKKDALCRDAKRRAMKTCAVLLAKIK

SEQ ID NO: 8539 - protein, 51 aa, Artificial Sequence
  Computer-generated peptide variant
IFKLFKKWLRRLRHKQRSLARLKQLDVKRSHDRKARHMLNLLQRMRFLDID

SEQ ID NO: 8540 - protein, 24 aa, Artificial Sequence
  Computer-generated peptide variant
LWKLLRRILKILKRLTKWTKFTPH

SEQ ID NO: 8541 - protein, 21 aa, Artificial Sequence
  Computer-generated peptide variant
LIKMINKLLKKFCRWAYRRAL

SEQ ID NO: 8542 - protein, 44 aa, Artificial Sequence
  Computer-generated peptide variant
KLKMLRRFLKRLNCLAKYKLIQANGCRREQIACWAQKKPGAKAL

SEQ ID NO: 8543 - protein, 60 aa, Artificial Sequence
  Computer-generated peptide variant
FYRFLPKILKKMPKLHKWHMDIREAAKVLITRKLSMRVHRLALLWAKHAAAKPDLKKNAV

SEQ ID NO: 8544 - protein, 47 aa, Artificial Sequence
  Computer-generated peptide variant
LYRYFRKYIRWFNQWDYKKAKKCGRKSKCLFKATPIRLLRALARVAL

SEQ ID NO: 8545 - protein, 40 aa, Artificial Sequence
  Computer-generated peptide variant
RWRLLKKLYRKYKNIPGDAAEAACGMVRRLALPLALLRNK

SEQ ID NO: 8546 - protein, 21 aa, Artificial Sequence
  Computer-generated peptide variant
FYRIFQKLLKLLKKMKYDAWK

SEQ ID NO: 8547 - protein, 80 aa, Artificial Sequence
  Computer-generated peptide variant
FWKLFNKFFRLFRRLALWMRLARWLARVPARKKRLKPIDRCKEPPLPPAPLFYEAYRLALLLKKLLKSDVTLRLQMLFKP

SEQ ID NO: 8548 - protein, 24 aa, Artificial Sequence
  Computer-generated peptide variant
LFRLLKKYLRMIQCRLIPRARADL

SEQ ID NO: 8549 - protein, 59 aa, Artificial Sequence
  Computer-generated peptide variant
KLKLMKKMFRMLKRAKALRETLYQNRLVLARARAERPLLDAQLRHRLAYITGYWMPHVR

SEQ ID NO: 8550 - protein, 23 aa, Artificial Sequence
  Computer-generated peptide variant
RFRFYQKLLRRYHKDLRARLAHQ

SEQ ID NO: 8551 - protein, 82 aa, Artificial Sequence
  Computer-generated peptide variant
LIRYMKRLLKLLRRQEELCRTAEWAKRRRQLRLKKPALAQMQLGKLAFIEAFTEVARMYAKKLQIKLLIRLRNCTGRSRALL

SEQ ID NO: 8552 - protein, 51 aa, Artificial Sequence
  Computer-generated peptide variant
LFRIFRKFFKFYRRLLRHSLKYLDCRDAAKALLAGWTDDRKMALARASLAN

SEQ ID NO: 8553 - protein, 27 aa, Artificial Sequence
  Computer-generated peptide variant
KFRFLKKLLKRLRKMPFIQTAGTALIG

SEQ ID NO: 8554 - protein, 59 aa, Artificial Sequence
  Computer-generated peptide variant
RMRMFKRIMKRFNRRAAWLGKLDKKMRPAQLPRLVRKAALLNWATKKKLIAWAPRGTFV

SEQ ID NO: 8555 - protein, 22 aa, Artificial Sequence
  Computer-generated peptide variant
RMKLWQRILRYYSRWLILAKLA

SEQ ID NO: 8556 - protein, 26 aa, Artificial Sequence
  Computer-generated peptide variant
RFRLLKKLLKMLHKYAAHFALKDKKE

SEQ ID NO: 8557 - protein, 22 aa, Artificial Sequence
  Computer-generated peptide variant
RLKLMQKLLRFFHKQAARYHAC

SEQ ID NO: 8558 - protein, 47 aa, Artificial Sequence
  Computer-generated peptide variant
LLKLLQKFLRRLRKRYARQRMSAHWLDKYKWSKAHLTDTEKITLALF

SEQ ID NO: 8559 - protein, 54 aa, Artificial Sequence
  Computer-generated peptide variant
RFKFLNRFLKIFKRGPPANKKPKKRRAQCESSKKQLAWRLLQRQPLAKKLQLGA

SEQ ID NO: 8560 - protein, 30 aa, Artificial Sequence
  Computer-generated peptide variant
LWKMYHRIIRRYKRKLAARFKRDALFPARL

SEQ ID NO: 8561 - protein, 41 aa, Artificial Sequence
  Computer-generated peptide variant
FIKFFRRYLRYYKRKLRKLDFAAAAFALARCHKKAQLPSKR

SEQ ID NO: 8562 - protein, 86 aa, Artificial Sequence
  Computer-generated peptide variant
KMRFYNRMLRKLTSKTVMMLRLKRHRAMFLVNRLMKTEKFMAWMAAKRLRLLDLERAQRKKLMEALHQLKERKHIKLGLELATTAW

SEQ ID NO: 8563 - protein, 71 aa, Artificial Sequence
  Computer-generated peptide variant
LYKLWRKFLRLIRRQKFAWYLKLDYLFCAGAAKKKRRLMLWKYKDEASFAFMLLRVVKIALIHYLWRIRVR

SEQ ID NO: 8564 - protein, 44 aa, Artificial Sequence
  Computer-generated peptide variant
MLRLLHRLFKKWRTKLLGYKPPKNGLATMNALKAHKAYSTRAKE

SEQ ID NO: 8565 - protein, 25 aa, Artificial Sequence
  Computer-generated peptide variant
RYKLLPKLLRFLNKKRMKVWCAQLV

SEQ ID NO: 8566 - protein, 21 aa, Artificial Sequence
  Computer-generated peptide variant
WLRYWRKMLRLLKRQMLQWKA

SEQ ID NO: 8567 - protein, 72 aa, Artificial Sequence
  Computer-generated peptide variant
FMRLLPRLLKRFQRKPTALLDQDREAAFSAEKLKIKMKALEMRLLKAFLPKKLRLAQRTYPKCKMKKYVFWY

SEQ ID NO: 8568 - protein, 60 aa, Artificial Sequence
  Computer-generated peptide variant
LFRLFQKLFRLFKSVDRLWIIKKKFMAKFRYYARAALGVGRVARCLMRAAVKNRARMLCL

SEQ ID NO: 8569 - protein, 63 aa, Artificial Sequence
  Computer-generated peptide variant
LLKIIKKLLRLLKKKRPLYQRFPGTRNFDRLREAMNLTLIKLERSVPNCLTWRWLKALLNAAT

SEQ ID NO: 8570 - protein, 33 aa, Artificial Sequence
  Computer-generated peptide variant
KLRYIRKLYRMFRHLKNSEEARLPRLTLLKWKC

SEQ ID NO: 8571 - protein, 35 aa, Artificial Sequence
  Computer-generated peptide variant
LMKMLKKLLKRLRRQCIVRQLRRWFTCFCLLRVLG

SEQ ID NO: 8572 - protein, 59 aa, Artificial Sequence
  Computer-generated peptide variant
WLRWWQRMLKRIRKLAHLWTKRKVTKRQLQAAHQRTRSKRSAFARTLQDLPAKRAWAYL

SEQ ID NO: 8573 - protein, 54 aa, Artificial Sequence
  Computer-generated peptide variant
LFKILRKLFKKLRKQLHMWFIFAKRAVLRRYESLTNAQWKKTVRLRLNARKREQ

SEQ ID NO: 8574 - protein, 45 aa, Artificial Sequence
  Computer-generated peptide variant
KFRLFHRLMRRFSNAGRVARLHRARAPKACDKRLVRYFAKPDRNL

SEQ ID NO: 8575 - protein, 57 aa, Artificial Sequence
  Computer-generated peptide variant
LIRFLKKFLRFFPKHLALRIKIKTAPKRLTKTALDYIMLTRPRKLNDIQATRKADRR

SEQ ID NO: 8576 - protein, 40 aa, Artificial Sequence
  Computer-generated peptide variant
YMKWFPKFLKRLRPVRLCLTFCLRAIDKVMEWAAKRKKAR

SEQ ID NO: 8577 - protein, 47 aa, Artificial Sequence
  Computer-generated peptide variant
KLKWWKRIFKRYKRRASKWASLCAAAKAIARKLKDLSIISNYLCCAA

SEQ ID NO: 8578 - protein, 24 aa, Artificial Sequence
  Computer-generated peptide variant
FMRLLKKFYKLWNTPRLLAAWLQR

SEQ ID NO: 8579 - protein, 71 aa, Artificial Sequence
  Computer-generated peptide variant
LLKYLRRYWKLFRKRAYKCALMYKRHHKAAANTRKQLWLGRHILETLRHQKADPKMKPLSQCLRAQLPRAL

SEQ ID NO: 8580 - protein, 34 aa, Artificial Sequence
  Computer-generated peptide variant
KYKLLRRMLKRFKNADTPRRRIAEPDKAMHLALM

SEQ ID NO: 8581 - protein, 45 aa, Artificial Sequence
  Computer-generated peptide variant
KIRLLKRLLRKIPCHLFMKLRGKTRKHEAWNRRNAHAKWLYGAKI

SEQ ID NO: 8582 - protein, 27 aa, Artificial Sequence
  Computer-generated peptide variant
YLRWLRRLYKLMHTLSRALRYNKWLRK

SEQ ID NO: 8583 - protein, 63 aa, Artificial Sequence
  Computer-generated peptide variant
RLKYFRKLLRFIKRKQAPKQLAPGIQLRFNRYYLRAHFMKKDALAKATLRQDAPERELCLNCL

SEQ ID NO: 8584 - protein, 47 aa, Artificial Sequence
  Computer-generated peptide variant
LLRWLPRLYRRWKHRREGKHLLLIVVTQLADMSKKGKEAVAMAKAAR

SEQ ID NO: 8585 - protein, 40 aa, Artificial Sequence
  Computer-generated peptide variant
LIRLMKKWIRKFRKRKRRVAKLALLVIALLWVPCTDYVLK

SEQ ID NO: 8586 - protein, 54 aa, Artificial Sequence
  Computer-generated peptide variant
KLRFYRRLFKFLQHRTKARNSAWCVFMLKRNRRRRNVRIARCIALLLLWRLAQL

SEQ ID NO: 8587 - protein, 31 aa, Artificial Sequence
  Computer-generated peptide variant
KWKFLNKLFKFLKKACRCLARFYTRLARLAH

SEQ ID NO: 8588 - protein, 33 aa, Artificial Sequence
  Computer-generated peptide variant
RMRIFQKWLKYLRRRMWNGKAKLAEKSLLLAAC

SEQ ID NO: 8589 - protein, 76 aa, Artificial Sequence
  Computer-generated peptide variant
ILRYLRRLYRLIRPLCYATLKPARKLRKHKQLVDDSKDLPSICLYRQLFTLRAPARLPMRKEALRPRKTELALRDK

SEQ ID NO: 8590 - protein, 48 aa, Artificial Sequence
  Computer-generated peptide variant
WLKIFKRMLRIWSKLRQRQKRAKYLAQAEKAARRRWQEIMRALNLPRL

SEQ ID NO: 8591 - protein, 83 aa, Artificial Sequence
  Computer-generated peptide variant
FLKWLQRYFKKFRKLLYKELAAFLAKKLLWQPDRKRYALREELKKASQAFIRHKCFSRLPKDFVLKYEGKKVAMYARKVKKGF

SEQ ID NO: 8592 - protein, 44 aa, Artificial Sequence
  Computer-generated peptide variant
FIRLWRKLLRRYPTRGASFHRDAGLYLKMKMKDMRALPLKRAFA

SEQ ID NO: 8593 - protein, 25 aa, Artificial Sequence
  Computer-generated peptide variant
ILRFLKKWMRKWNSALVLRAKTLYK

SEQ ID NO: 8594 - protein, 33 aa, Artificial Sequence
  Computer-generated peptide variant
LYRLLTRFLKFFRSCAVLALSKHAGRKRYFLMR

SEQ ID NO: 8595 - protein, 35 aa, Artificial Sequence
  Computer-generated peptide variant
RWRLLRRLLRMFKRNQAERTPLNKPSKLKLKAMNH

SEQ ID NO: 8596 - protein, 48 aa, Artificial Sequence
  Computer-generated peptide variant
RFKMYRRILKLLRRALPALLACSIFRRLWLLRKARPMIIRIHADLGQK

SEQ ID NO: 8597 - protein, 21 aa, Artificial Sequence
  Computer-generated peptide variant
LYKWFKRLYRRMSKACCAANL

SEQ ID NO: 8598 - protein, 38 aa, Artificial Sequence
  Computer-generated peptide variant
RFRILNRLIKLMHRASSVLRHLAVKKGMAHARAKMKHW

SEQ ID NO: 8599 - protein, 58 aa, Artificial Sequence
  Computer-generated peptide variant
RYRLICKWFRFYRKGATARKVAYRTAALPARGGRKFQANATLLYMKTAVKKKSTAIRK

SEQ ID NO: 8600 - protein, 61 aa, Artificial Sequence
  Computer-generated peptide variant
RFKFLRKLLRRLHKQKILMELHVRLYALLGHRMKAHVLVLYLRVPKFHQRAVDRLAARRWQ

SEQ ID NO: 8601 - protein, 31 aa, Artificial Sequence
  Computer-generated peptide variant
MLKWMKRLWRLLPRIALFTARWSRMKRARFW

SEQ ID NO: 8602 - protein, 34 aa, Artificial Sequence
  Computer-generated peptide variant
LLKYFKRIFRLFKKLAEAHNRLRFTVAAVRLRQP

SEQ ID NO: 8603 - protein, 65 aa, Artificial Sequence
  Computer-generated peptide variant
MWRILRKLLKRIKRKLLASEKDLLKEDVITCVAPMLKARHLSCRAKAMHRMFALAKCGACRIPRS

SEQ ID NO: 8604 - protein, 43 aa, Artificial Sequence
  Computer-generated peptide variant
IFRIFRKLLKFLRKHYYQAYLWRLRALMEQTLAKWRADARRRY

SEQ ID NO: 8605 - protein, 45 aa, Artificial Sequence
  Computer-generated peptide variant
RLRMLKRIIKLYKSYNCQAYAKYRNWKLKLAKAKLGLVFKGACHR

SEQ ID NO: 8606 - protein, 53 aa, Artificial Sequence
  Computer-generated peptide variant
MLRLWRRIMRRLKKEAKAAWDGLYAARARDRLRQRALEFLYFPQSRGVFPFRK

SEQ ID NO: 8607 - protein, 20 aa, Artificial Sequence
  Computer-generated peptide variant
KFRLYKRLLRMWRPRLACNF

SEQ ID NO: 8608 - protein, 47 aa, Artificial Sequence
  Computer-generated peptide variant
KLKLFRRLYKFFPKLGKNSNVSLLHCPAHKARGFAERAARKKLLQLS

SEQ ID NO: 8609 - protein, 59 aa, Artificial Sequence
  Computer-generated peptide variant
IIKMLCRYLRRYHNLYHKDMLKEAETMLKRRSLLRRAARKCWAPAMRRQCLLRIYSRLA

SEQ ID NO: 8610 - protein, 49 aa, Artificial Sequence
  Computer-generated peptide variant
LLRILRRFYRRLRRHLKVNLMHLLAKLKRKNLEAKCLRMNWPFLNHPLS

SEQ ID NO: 8611 - protein, 30 aa, Artificial Sequence
  Computer-generated peptide variant
RLKLFKKFFKYLHRPWLWFLKEARMRKVLS

SEQ ID NO: 8612 - protein, 29 aa, Artificial Sequence
  Computer-generated peptide variant
KFRIWRRLLKFYCNRLDAIKLKAKLQLLV

SEQ ID NO: 8613 - protein, 38 aa, Artificial Sequence
  Computer-generated peptide variant
FLRYIQRLLKRFRQASNRACRSAQLAKLKQERQAGRYA

SEQ ID NO: 8614 - protein, 26 aa, Artificial Sequence
  Computer-generated peptide variant
YLRLFPKFLRLLKHPLKKRYRHAFMR

SEQ ID NO: 8615 - protein, 68 aa, Artificial Sequence
  Computer-generated peptide variant
RFKFLKRLLKMLHRRKSHAKLHARETKDLPEMRLCRLGKAHLELLSKFAWGGATGQMALAERALLLVK

SEQ ID NO: 8616 - protein, 85 aa, Artificial Sequence
  Computer-generated peptide variant
RMKLLKRLIKYFRKGMAFALLEAYAFAKSKKALKHAQHVRPTKKYDLLILWEAKFNKVALRNRKAKLLCLSRGLRALPKVKHKMI

SEQ ID NO: 8617 - protein, 26 aa, Artificial Sequence
  Computer-generated peptide variant
RMRMFCRLLRRIKNLTALRAQALSHH

SEQ ID NO: 8618 - protein, 32 aa, Artificial Sequence
  Computer-generated peptide variant
LLRYLPRLLRKLTNRLKRRLATGRMYFARLRK

SEQ ID NO: 8619 - protein, 78 aa, Artificial Sequence
  Computer-generated peptide variant
FLKLFKRLLKKWRKAGRLKLGLRQQKALFFYRMYVAKYKLRRKALAFEAKRSYAQNAHVGKWRQKHRNTKRAMDGLEL

SEQ ID NO: 8620 - protein, 20 aa, Artificial Sequence
  Computer-generated peptide variant
KLRWWPRMIRLFRRLCLATM

SEQ ID NO: 8621 - protein, 40 aa, Artificial Sequence
  Computer-generated peptide variant
RMKFWRKLMRMFPNCALKELKAAKKYKLIHARLHASIARR

SEQ ID NO: 8622 - protein, 41 aa, Artificial Sequence
  Computer-generated peptide variant
KYKLLCRLFRLFRRWRARRGPALDAANQVERSSANKLVNVL

SEQ ID NO: 8623 - protein, 78 aa, Artificial Sequence
  Computer-generated peptide variant
KWKLIRKFMRKMRRGLIALPGLKFYKAPKSVRAPLKNSAAPKRKNKGKAKTFKNLDAAYLWYLELQKHSNQAKLKCRF

SEQ ID NO: 8624 - protein, 29 aa, Artificial Sequence
  Computer-generated peptide variant
RIRFMNKWWKRLRPANASAFKRRWLANAT

SEQ ID NO: 8625 - protein, 28 aa, Artificial Sequence
  Computer-generated peptide variant
RYKLFNKYLKKIKKALAALMEKEWQAPG

SEQ ID NO: 8626 - protein, 27 aa, Artificial Sequence
  Computer-generated peptide variant
KLRMYQRFWKMLRRLDLDMTRIAASLK

SEQ ID NO: 8627 - protein, 26 aa, Artificial Sequence
  Computer-generated peptide variant
RLRILRKLLRWLRRAWLQYVEACPDI

SEQ ID NO: 8628 - protein, 58 aa, Artificial Sequence
  Computer-generated peptide variant
FLRFWKKYLRKYTKLASRVRKGRVAELANLILVQSHAGLKGLLQKRRIKLRACAQTKR

SEQ ID NO: 8629 - protein, 50 aa, Artificial Sequence
  Computer-generated peptide variant
MFKLMSKWLKLLRCAERLRKKALHLAKAMFLKDDERLSRMCDQRGWRFTL

SEQ ID NO: 8630 - protein, 81 aa, Artificial Sequence
  Computer-generated peptide variant
KFRYMKRLYKFLTNRLERLGLAPRWLCMGLKGKQQRARKGKGKLAEIPLKARIFKAPRKDRRRLLEVPLHTYKKYLLRWAI

SEQ ID NO: 8631 - protein, 44 aa, Artificial Sequence
  Computer-generated peptide variant
KFKLFNRIYRFLKSGQPLRRVLLALNHLRVRAKAKLTEKQLRMA

SEQ ID NO: 8632 - protein, 60 aa, Artificial Sequence
  Computer-generated peptide variant
RWRMLNRMFKFLRPIKKTALWETKARLRRRYMKDELQLWKVLSARMVAAWVARYHLLNKA

SEQ ID NO: 8633 - protein, 58 aa, Artificial Sequence
  Computer-generated peptide variant
KLKIFHRFFKFFKKQLKQKLLLCFSAKTSKQATAFAAAARARLSKYKLLYRIQRFGAA

SEQ ID NO: 8634 - protein, 49 aa, Artificial Sequence
  Computer-generated peptide variant
KLRLLTKLMKKWRCKYAKFAALPRDEASSKTARFKFCHAHGRAGAGRAP

SEQ ID NO: 8635 - protein, 31 aa, Artificial Sequence
  Computer-generated peptide variant
RFRWLSKMLKYYRKVAHQAKLNHKLRVFALR

SEQ ID NO: 8636 - protein, 40 aa, Artificial Sequence
  Computer-generated peptide variant
RLRMWQRFMRRFSKMLLCLKKRLALAAKLLNPKKDTNLSR

SEQ ID NO: 8637 - protein, 29 aa, Artificial Sequence
  Computer-generated peptide variant
FIRLFCKLLKKLKRLFALKRRRRLAKALC

SEQ ID NO: 8638 - protein, 28 aa, Artificial Sequence
  Computer-generated peptide variant
FLRFLKKLFKMIHKKLDAGHKEKLALAM

SEQ ID NO: 8639 - protein, 50 aa, Artificial Sequence
  Computer-generated peptide variant
RLKWIRKLLRYMQKRTSRRAATRLAALGAKMDIQHIFTKRHRLLLDQLPW

SEQ ID NO: 8640 - protein, 47 aa, Artificial Sequence
  Computer-generated peptide variant
ILKMWKKYLRRWKKLFEWLKALHCARGRPCGKKKMARLCQREGMAAM

SEQ ID NO: 8641 - protein, 41 aa, Artificial Sequence
  Computer-generated peptide variant
FLRFIPKFLRFLNCALAKHKMNRKATRKRLLRRKGVGAKRA

SEQ ID NO: 8642 - protein, 30 aa, Artificial Sequence
  Computer-generated peptide variant
LIKIFKRLFRYLKKCVELIVLRCHKLRAKA

SEQ ID NO: 8643 - protein, 68 aa, Artificial Sequence
  Computer-generated peptide variant
WLKFYKRYIRRLKRSAFALMWKVQYHKARLLAASALACNELNRAGKAALLNVTNRSIMEARSYKTKLL

SEQ ID NO: 8644 - protein, 43 aa, Artificial Sequence
  Computer-generated peptide variant
LYKLLKRLLRKYKRRWEWGMGAALQKMSKKNCLWLPGALTHGK

SEQ ID NO: 8645 - protein, 33 aa, Artificial Sequence
  Computer-generated peptide variant
RLKMFRKLLKRINKLALRLMKQKTLKDAQPTIK

SEQ ID NO: 8646 - protein, 25 aa, Artificial Sequence
  Computer-generated peptide variant
LYKLLNRFLRRFKRALQTVKCCWRY

SEQ ID NO: 8647 - protein, 53 aa, Artificial Sequence
  Computer-generated peptide variant
RLKYLTKFYRIYNRLRAPPWLHYRRRKMADQKKLHRRLKKACNAMLVKEALHL

SEQ ID NO: 8648 - protein, 25 aa, Artificial Sequence
  Computer-generated peptide variant
MYKMLTRLMKKYKKLYLGRALKAFL

SEQ ID NO: 8649 - protein, 79 aa, Artificial Sequence
  Computer-generated peptide variant
KWKYLCKLLRYFTKMRRRPDIKGFCALIAFKHKRKWHGEKWTLAADLALARRLVWSLPKKKRLRRGLHMKLSCRLAKSF

SEQ ID NO: 8650 - protein, 93 aa, Artificial Sequence
  Computer-generated peptide variant
KLRYLRKIIRFMHCALKKYKYLRQRRAREHKGARRRMKLHYKYKRELRAAYMAAPIAKHYSREAKGPGLMTKLERALPAGRLCRTLAWRQHVE

SEQ ID NO: 8651 - protein, 30 aa, Artificial Sequence
  Computer-generated peptide variant
KLRFIRKFWKIYSKAMLKAKHAAELDGDLL

SEQ ID NO: 8652 - protein, 43 aa, Artificial Sequence
  Computer-generated peptide variant
KYKLMKKWLKMYKKLAQEKVPPHRMAMHRKTQQLRLLRAIAAN

SEQ ID NO: 8653 - protein, 38 aa, Artificial Sequence
  Computer-generated peptide variant
RLRYLCRLLRKLRHEKMLRLERWLLNDRTTFKHHKAKL

SEQ ID NO: 8654 - protein, 83 aa, Artificial Sequence
  Computer-generated peptide variant
KYKMFPRFYRKYKKGSFAAWIFNLQKRRRRVRILRKAKCFHVAAKLTKRYLLSADMALIAATHKMLLKRTNLMVRILLRLRML

SEQ ID NO: 8655 - protein, 25 aa, Artificial Sequence
  Computer-generated peptide variant
LYKWMQRLLRIYPRKARALLTAKQA

SEQ ID NO: 8656 - protein, 64 aa, Artificial Sequence
  Computer-generated peptide variant
LYRYWRKFFRKLRRARLLASANQWILLCMTRPLLALRFKAQKWAKSAKRDKYVAALAHIARAMM

SEQ ID NO: 8657 - protein, 35 aa, Artificial Sequence
  Computer-generated peptide variant
MLRFLTRLWRKMNKRAKALKVDAYQAQYRTTLRAK

SEQ ID NO: 8658 - protein, 31 aa, Artificial Sequence
  Computer-generated peptide variant
KYRLFKKLLRKYPRAQAQPLECAQRSAKTAL

SEQ ID NO: 8659 - protein, 45 aa, Artificial Sequence
  Computer-generated peptide variant
KWRLMKKFYRFIQKLRELATEALWRSERRLLSLAANTFLHGRDRL

SEQ ID NO: 8660 - protein, 58 aa, Artificial Sequence
  Computer-generated peptide variant
YYKLFRRFLRRLHCALLTKRFRKEFARWHDMKLLHLRGDRLNALTWCIRLRLRLAVKA

SEQ ID NO: 8661 - protein, 47 aa, Artificial Sequence
  Computer-generated peptide variant
YWRLWTKYLKRMRNRKHQLNGRCLMAKYNVRVKAAKLHVALRRMLRA

SEQ ID NO: 8662 - protein, 40 aa, Artificial Sequence
  Computer-generated peptide variant
FIKLLKRLYKYFRKEAQWLAQQDRAAALPKIMDRAKALKL

SEQ ID NO: 8663 - protein, 36 aa, Artificial Sequence
  Computer-generated peptide variant
YFKYMRKLFKLMRKKIAGPNAIRTAETRVACALKLA

SEQ ID NO: 8664 - protein, 25 aa, Artificial Sequence
  Computer-generated peptide variant
KFRIMSRLLRKIKKWAKLVLARCTA

SEQ ID NO: 8665 - protein, 53 aa, Artificial Sequence
  Computer-generated peptide variant
RFRFLKRLLKRLHHHVAGAARLKARATSPGYQNARADIRYAPRLRLEERLDVC

SEQ ID NO: 8666 - protein, 45 aa, Artificial Sequence
  Computer-generated peptide variant
LLRIIKRLFKWLTTKNKKTYPPMILNKLAAGRRMPLGLRKLRAED

SEQ ID NO: 8667 - protein, 25 aa, Artificial Sequence
  Computer-generated peptide variant
YLKLWRRFYKRLKTRKLTSLFSHAN

SEQ ID NO: 8668 - protein, 41 aa, Artificial Sequence
  Computer-generated peptide variant
KFKLLTKLIRRYRKMALRMLDYAALLRLMKIEEGAKLKLVR

SEQ ID NO: 8669 - protein, 56 aa, Artificial Sequence
  Computer-generated peptide variant
RIKMLRKFFKRWKCLFVYFLKLHKKIFSRRLPEKWALYLYALLQLGRAKEVDRLLA

SEQ ID NO: 8670 - protein, 36 aa, Artificial Sequence
  Computer-generated peptide variant
RLRLFRRMLKFIKKPACNKHPAQQLLMLHGRCAKRQ

SEQ ID NO: 8671 - protein, 76 aa, Artificial Sequence
  Computer-generated peptide variant
ILRMIRRFFRRLKHLKRAHDQRPRRLAGALGHRSSPPKIKARAHLAFMLMDLRKNAPATRNLRCGIAHRNAISALA

SEQ ID NO: 8672 - protein, 47 aa, Artificial Sequence
  Computer-generated peptide variant
FIKWFKRLLRRWTRILKLATIAEYKYLYLALRNAARDQMERRSSLMA

SEQ ID NO: 8673 - protein, 33 aa, Artificial Sequence
  Computer-generated peptide variant
RLRILPRLWRKLRPLRNRWDSLPKVKLYQAASW

SEQ ID NO: 8674 - protein, 85 aa, Artificial Sequence
  Computer-generated peptide variant
RLRILKKMMKRFKRYLGAETAPNSLHLEHRRALTCLSKALKAQAASLMRRQRIDIRAKARKKLCANMMPVKCLAMPKSQLIKMKD

SEQ ID NO: 8675 - protein, 25 aa, Artificial Sequence
  Computer-generated peptide variant
KMKLMNKWLRRLKTVKQATFLSTKL

SEQ ID NO: 8676 - protein, 39 aa, Artificial Sequence
  Computer-generated peptide variant
FYRLLKRIYKMLSRRNDTKAMLKKILNDKVARQLAMKAL

SEQ ID NO: 8677 - protein, 27 aa, Artificial Sequence
  Computer-generated peptide variant
LLRFIRRLLRFMRQELKRKILRSLNHC

SEQ ID NO: 8678 - protein, 21 aa, Artificial Sequence
  Computer-generated peptide variant
RWRFLPKILKRMKKSLLSPAC

SEQ ID NO: 8679 - protein, 63 aa, Artificial Sequence
  Computer-generated peptide variant
WLRLIKKFLRWLRSKLYRARASNEKCALRLLARRRDAEMLALLTIKNIDYKKRSKEFTPAKEM

SEQ ID NO: 8680 - protein, 28 aa, Artificial Sequence
  Computer-generated peptide variant
KIRWLKRILKLFTQVLKKRALLKMFYDA

SEQ ID NO: 8681 - protein, 40 aa, Artificial Sequence
  Computer-generated peptide variant
RIKYLRKMYKKWKQKVLFAKHLLAKKCKAARLGKCLVLTI

SEQ ID NO: 8682 - protein, 53 aa, Artificial Sequence
  Computer-generated peptide variant
LLKWMKRLLKLLTKKAFLYLDGDMARWTKMEYKALLRKMRRREENSLHLSLWQ

SEQ ID NO: 8683 - protein, 48 aa, Artificial Sequence
  Computer-generated peptide variant
RFRLLKRFFKFLHKPKYKLNKGKKLAYRYTFACTTATLWRLTRKKAEA

SEQ ID NO: 8684 - protein, 29 aa, Artificial Sequence
  Computer-generated peptide variant
RLRWIPKLIRFLRKRLPYWHALKTFEEKA

SEQ ID NO: 8685 - protein, 50 aa, Artificial Sequence
  Computer-generated peptide variant
RLKFMKKYWKMWRKMALLTRLRLAMRAERLKVDNGRNQHALQKKKLARYC

SEQ ID NO: 8686 - protein, 50 aa, Artificial Sequence
  Computer-generated peptide variant
ILKFFRRLYRLLRCMCHIRIRYMENAGRWRRAPMLAALALLLWRLRQRTP

SEQ ID NO: 8687 - protein, 93 aa, Artificial Sequence
  Computer-generated peptide variant
RIRFFSRLLKKLKQLLQGAAAIKRALGLLQARRRRNHKALKRKEHNFRLAAIHLAKQTFFAFFRLRIMALSAKYVWQNPDYISRAANRRGRKV

SEQ ID NO: 8688 - protein, 34 aa, Artificial Sequence
  Computer-generated peptide variant
RLRLFKKWFKRMNRFHWLASLLTARLDHIRMKGL

SEQ ID NO: 8689 - protein, 30 aa, Artificial Sequence
  Computer-generated peptide variant
FFKLMRRLWRKMQRLALRIALLIRPYAEPQ

SEQ ID NO: 8690 - protein, 50 aa, Artificial Sequence
  Computer-generated peptide variant
RLKMLRRLMRRITRLWTLRSAIAYYWRKRWLAEGKLLALPRLRAGARAKP

SEQ ID NO: 8691 - protein, 48 aa, Artificial Sequence
  Computer-generated peptide variant
RLKYLKRLLRLLSPYEKPKKKWGASSRRKKHARHVVMALPAALLHIGG

SEQ ID NO: 8692 - protein, 59 aa, Artificial Sequence
  Computer-generated peptide variant
KFKYLNKFLRLLCRFLLRQPSRNLHALLGLARKKGKKSIAKGWANYKHDRMRLGWIKRA

SEQ ID NO: 8693 - protein, 25 aa, Artificial Sequence
  Computer-generated peptide variant
RLKLLRKWLRKWHKLVCHACPGLKA

SEQ ID NO: 8694 - protein, 25 aa, Artificial Sequence
  Computer-generated peptide variant
KLRMWCKWLRWLSRRYKDDANLTAK

SEQ ID NO: 8695 - protein, 28 aa, Artificial Sequence
  Computer-generated peptide variant
KFRMWKRLFKKYRRAPCAPLAVLLTTAR

SEQ ID NO: 8696 - protein, 29 aa, Artificial Sequence
  Computer-generated peptide variant
MLRILRRYMKKLRQIKKASKPAAQNCQLM

SEQ ID NO: 8697 - protein, 52 aa, Artificial Sequence
  Computer-generated peptide variant
IFRLLSKLLRILRNALKASLRVSKAVAYSYALKCNKKARNKKKAMRDNTLVA

SEQ ID NO: 8698 - protein, 81 aa, Artificial Sequence
  Computer-generated peptide variant
KWRLYTKILKKIRKEPYRYLNNVALLRWYLYLRRHHKMIAKPHLLMATACRLYFALRLDDKQRCRLAAHKGKKRGWKTKRH

SEQ ID NO: 8699 - protein, 21 aa, Artificial Sequence
  Computer-generated peptide variant
RYKLLRKLLRRITPRMTAAWL

SEQ ID NO: 8700 - protein, 24 aa, Artificial Sequence
  Computer-generated peptide variant
MFRLFRKYMRMLRHRKAANTTLKL

SEQ ID NO: 8701 - protein, 23 aa, Artificial Sequence
  Computer-generated peptide variant
KYKFLQRYFRRFCSFARHLALLK

SEQ ID NO: 8702 - protein, 47 aa, Artificial Sequence
  Computer-generated peptide variant
KFKFMCKLYKIIKRTALALQLRRWQKMLQRQPRLLADSRKALRIPWG

SEQ ID NO: 8703 - protein, 57 aa, Artificial Sequence
  Computer-generated peptide variant
RWKWLHRLLRRLTKAKKLMIFRFLRCAARGIRLLKERKRVCWAYRLEGARESVWCKP

SEQ ID NO: 8704 - protein, 25 aa, Artificial Sequence
  Computer-generated peptide variant
KIKIYTKLLRKWRKRVALADDVLAK

SEQ ID NO: 8705 - protein, 35 aa, Artificial Sequence
  Computer-generated peptide variant
KYRLYKKWIRKFRRKMRDLRTALVLGVANCLAANS

SEQ ID NO: 8706 - protein, 38 aa, Artificial Sequence
  Computer-generated peptide variant
YLRLLSRYLKYWRRKSSKRLPASRRFRAQYGARIAQHM

SEQ ID NO: 8707 - protein, 52 aa, Artificial Sequence
  Computer-generated peptide variant
RFRFLKKLWKKMSRRRQWRKARCLHRRKLGCALAMIALIFEEYLLEKFFSRF

SEQ ID NO: 8708 - protein, 34 aa, Artificial Sequence
  Computer-generated peptide variant
ILKWLKKFIRRWSRLARRLLATEMLRLTNLDWLM

SEQ ID NO: 8709 - protein, 28 aa, Artificial Sequence
  Computer-generated peptide variant
FIRYLKKLIKKMKKLLARKAAARLFWKA

SEQ ID NO: 8710 - protein, 77 aa, Artificial Sequence
  Computer-generated peptide variant
FMRFIKKLIKLLKRSKANQLAQQWPRGFGIDFKRLAKGKRILQNAARNRTAALVRALKFRAVDRRALDHLALHQYLH

SEQ ID NO: 8711 - protein, 97 aa, Artificial Sequence
  Computer-generated peptide variant
YFKYIPKMLRKLRHTVYRRAAVAKVRKTKLLTEASGRHSAKHCKKLMSLRSLLRKCCFRFAKKALVRDMLKACYRLALGLRQCNCLAYRKAYASRNR

SEQ ID NO: 8712 - protein, 27 aa, Artificial Sequence
  Computer-generated peptide variant
KMKLWRKLFRRFTKMAALKTRCELAQL

SEQ ID NO: 8713 - protein, 65 aa, Artificial Sequence
  Computer-generated peptide variant
LFKLLRKLWRKMRKRAKALRAKLSKKAKVGLNRQIGGNRARWCKCQCRAHKLGFKSVSALAIDRV

SEQ ID NO: 8714 - protein, 36 aa, Artificial Sequence
  Computer-generated peptide variant
KFRLLKKIFRFYKRLRLRRFISNMRDLASDVHAAAA

SEQ ID NO: 8715 - protein, 43 aa, Artificial Sequence
  Computer-generated peptide variant
LFRIWKKYFKYLQKVTAKCLKRRYRDLRKLLLMWSYRAGAHSL

SEQ ID NO: 8716 - protein, 67 aa, Artificial Sequence
  Computer-generated peptide variant
MYKILNKFFRLYKHLKYPKQKRLNSLAMDKQVLKRSMKKRLAAQRHILHALLRLYDKKERRLRWHAK

SEQ ID NO: 8717 - protein, 20 aa, Artificial Sequence
  Computer-generated peptide variant
LFRYLKKLLRKFPRLVCGRV

SEQ ID NO: 8718 - protein, 63 aa, Artificial Sequence
  Computer-generated peptide variant
RIRLLRKLLRLLRNIMRTNIARHLARIAMAMRLRRKKTWAYIRQLKLNQALWGMKKHLYCVLV

SEQ ID NO: 8719 - protein, 41 aa, Artificial Sequence
  Computer-generated peptide variant
RLRFMKRLLKKFKSQERLLKVTEMARLNSRKQIARAHALCW

SEQ ID NO: 8720 - protein, 21 aa, Artificial Sequence
  Computer-generated peptide variant
FLKLLRKLLKYLKKKSMKELR

SEQ ID NO: 8721 - protein, 34 aa, Artificial Sequence
  Computer-generated peptide variant
KLRFLKRLMRRWPSRYLRLRMACAKYIRAAAYRA

SEQ ID NO: 8722 - protein, 81 aa, Artificial Sequence
  Computer-generated peptide variant
KLKLYKRLYRYFKHYQADDKRRAYARKKAVIATSRRAKWATLKFKNLLDEKKATSCAGHSLKKHKLLLLNVDHSKCPKRSQ

SEQ ID NO: 8723 - protein, 27 aa, Artificial Sequence
  Computer-generated peptide variant
KLRWLQKWIRKFTQQARYKNAAARAYQ

SEQ ID NO: 8724 - protein, 40 aa, Artificial Sequence
  Computer-generated peptide variant
FFKLYKRMIRKWPSKAWLLWRKAKLMDTLKWVHAARQVRR

SEQ ID NO: 8725 - protein, 29 aa, Artificial Sequence
  Computer-generated peptide variant
LYRLIRRWFRRFNKALAITAAKHRQSQRA

SEQ ID NO: 8726 - protein, 24 aa, Artificial Sequence
  Computer-generated peptide variant
RLKLWRKMMKLFSHNAADTKLRWA

SEQ ID NO: 8727 - protein, 77 aa, Artificial Sequence
  Computer-generated peptide variant
RLKWWKRWLRKMNKKEILLHLRRSRKKKTAFWHIPKAAKYFHALKADLLMQCRPNAARTGRFIEMQAGARLLELAAM

SEQ ID NO: 8728 - protein, 31 aa, Artificial Sequence
  Computer-generated peptide variant
LLRYINRLLKFLRKELQLRTIWAWNRLKLKK

SEQ ID NO: 8729 - protein, 36 aa, Artificial Sequence
  Computer-generated peptide variant
KWRLWKRIFRKLKKIRSFTSKPEALNKIALMAIARA

SEQ ID NO: 8730 - protein, 51 aa, Artificial Sequence
  Computer-generated peptide variant
LLKLWKKMIKLYQKACKKLRLPNCARNRALKRLKGYKELVLWMKRHAWPRA

SEQ ID NO: 8731 - protein, 60 aa, Artificial Sequence
  Computer-generated peptide variant
KLKLLKRMFRKLKKCLYLLRAQPQSCALTWRVCAAELRLLCKKQRALKARWSWLGVGCER

SEQ ID NO: 8732 - protein, 70 aa, Artificial Sequence
  Computer-generated peptide variant
RWKIYPRYYRKFCRRFCALLLAMPYKCLKAEAKTMMVALALAVGRAKKLKRKKLHSDKYKLMRYIKEQRA

SEQ ID NO: 8733 - protein, 20 aa, Artificial Sequence
  Computer-generated peptide variant
RWKFLKKLFKLFQHAKRTLT

SEQ ID NO: 8734 - protein, 52 aa, Artificial Sequence
  Computer-generated peptide variant
RLKMIKKWLRLMHRNAIAKAKETDLTAAPALKRAYAVIFSFLKYQRKHKKCQ

SEQ ID NO: 8735 - protein, 34 aa, Artificial Sequence
  Computer-generated peptide variant
KYRWMKKILRLFKKTWARAFNALLRCLLIHYGHR

SEQ ID NO: 8736 - protein, 71 aa, Artificial Sequence
  Computer-generated peptide variant
KFRILRRYMKKWSNSLAKGAGSAAACAVHRARRASRAAAALFNRGPWLKAVCEKRLLWMCLRLKRFAIRRW

SEQ ID NO: 8737 - protein, 43 aa, Artificial Sequence
  Computer-generated peptide variant
LFKLYKKLYKRWHQSQKRKRKMRAICNLLAKSLHWATCKIAWA

SEQ ID NO: 8738 - protein, 41 aa, Artificial Sequence
  Computer-generated peptide variant
YLRLWQRLFKMLRPGSKPRNLKAYAITLALRIHRHLAASMK

SEQ ID NO: 8739 - protein, 65 aa, Artificial Sequence
  Computer-generated peptide variant
WIRIWSRLFRMWNRTALAQPNALKLAAKRKCRYRSKALVNWARLKIARKNDRSRKRAPRLDRKQA

SEQ ID NO: 8740 - protein, 74 aa, Artificial Sequence
  Computer-generated peptide variant
KYKLYKKWYKKLRCIPRQHKKCRDNEAPLPALKAKHAKYQASKAMYRRQANAYELKCRWKRKEIAKLARLARRA

SEQ ID NO: 8741 - protein, 52 aa, Artificial Sequence
  Computer-generated peptide variant
IFKLWTKFFKRYRPRMKIIRLLKRRYLENLGRRWAWQRCGAALADLLANRRN

SEQ ID NO: 8742 - protein, 88 aa, Artificial Sequence
  Computer-generated peptide variant
LFRIYKKFFRLLKCHREAVASARKCLEKKLRQKAWMYVKLERDLASKAAAKNYRYQNKTAKAERATRIKAIRTRRFKYRLKCWKATLL

SEQ ID NO: 8743 - protein, 38 aa, Artificial Sequence
  Computer-generated peptide variant
RWKILRKFIRFFRPVERARALDLRNLRLFRMVTLCWLA

SEQ ID NO: 8744 - protein, 24 aa, Artificial Sequence
  Computer-generated peptide variant
LWRLLKKFYKRIQNAARQSKKLLN

SEQ ID NO: 8745 - protein, 68 aa, Artificial Sequence
  Computer-generated peptide variant
KIKILKRYMRYLCKAGKKWKRWRLLFGIKKKHAARRKLMCRVKLRHLVRAQFKFALTALAHDAARTKY

SEQ ID NO: 8746 - protein, 55 aa, Artificial Sequence
  Computer-generated peptide variant
IFKFFKKMWKLFKKARASKRALVRMGHKKLTTPRPLASVDRVAEDLKCARACKKA

SEQ ID NO: 8747 - protein, 30 aa, Artificial Sequence
  Computer-generated peptide variant
KLKFLTRFLKKLKRARACRLQLCQAYARFT

SEQ ID NO: 8748 - protein, 24 aa, Artificial Sequence
  Computer-generated peptide variant
KLKILCKFYRRFSCALAKKNKLFS

SEQ ID NO: 8749 - protein, 32 aa, Artificial Sequence
  Computer-generated peptide variant
LYRMLRRWLRRFSTRLAALDWYLAKFVRGTMA

SEQ ID NO: 8750 - protein, 32 aa, Artificial Sequence
  Computer-generated peptide variant
FLRFLHRLWRRYKKNKKLCYTKTARCAAAGLK

SEQ ID NO: 8751 - protein, 21 aa, Artificial Sequence
  Computer-generated peptide variant
YLRLLRRYWRFIRQATNKRPA

SEQ ID NO: 8752 - protein, 40 aa, Artificial Sequence
  Computer-generated peptide variant
YLRYLHKILRRMRRLIQLESHLQKFATRILPIKNKKKGLA

SEQ ID NO: 8753 - protein, 32 aa, Artificial Sequence
  Computer-generated peptide variant
FLRLFRKYLRWFRQQWSLIDKRAASLVVARLL

SEQ ID NO: 8754 - protein, 52 aa, Artificial Sequence
  Computer-generated peptide variant
RWRWLRKWWRRFKRQLKKALIFVCTQGAGRLLLRKAPRAPKACTALCLWGLS

SEQ ID NO: 8755 - protein, 27 aa, Artificial Sequence
  Computer-generated peptide variant
KLKIFKRLLKFLKRAAYALLTRKFRAD

SEQ ID NO: 8756 - protein, 50 aa, Artificial Sequence
  Computer-generated peptide variant
RLRMMCKYMRFFKKLLRGHAAAAKKLHPPPKNCYATKLLHWCRKRVKAAE

SEQ ID NO: 8757 - protein, 32 aa, Artificial Sequence
  Computer-generated peptide variant
LLKLFKKMLKYLKSAAWCHQCERIRLMKYSKA

SEQ ID NO: 8758 - protein, 45 aa, Artificial Sequence
  Computer-generated peptide variant
KYRIYRKYLRFLKRTMKATIILQARLANRKQKMPSAQVKALTKYL

SEQ ID NO: 8759 - protein, 66 aa, Artificial Sequence
  Computer-generated peptide variant
WLKLLCKWLKRYRRLRHTALKMKARIHAYKCTRMALRKAKFPPKLAAARAKWKLYMLYPHKEGWDL

SEQ ID NO: 8760 - protein, 33 aa, Artificial Sequence
  Computer-generated peptide variant
LLRLFKKFLRYLRRKAGFDRRFAMAKRLIQPMA

SEQ ID NO: 8761 - protein, 33 aa, Artificial Sequence
  Computer-generated peptide variant
MFKLYRKLLRKYRTNLLKVHLAKWCLERLANYW

SEQ ID NO: 8762 - protein, 22 aa, Artificial Sequence
  Computer-generated peptide variant
IFKLLRKFMRKFQPAAALLPKH

SEQ ID NO: 8763 - protein, 34 aa, Artificial Sequence
  Computer-generated peptide variant
FFRMMRRWFKRWKKRTLDPLAALIRYRPAQALIL

SEQ ID NO: 8764 - protein, 88 aa, Artificial Sequence
  Computer-generated peptide variant
MYRMITKFIKRYNRNAPGSATRMRAFQYKEFMAKMPAKMKRWKKLALAHRRALLARANMRKLEICERYTLRAKKPKALRKYKRNWALC

SEQ ID NO: 8765 - protein, 23 aa, Artificial Sequence
  Computer-generated peptide variant
KIKWYRKLFRKLTRRAGKAAAQA

SEQ ID NO: 8766 - protein, 59 aa, Artificial Sequence
  Computer-generated peptide variant
FFRLLTRFWKRFPKDAKWLLYKLEKERRWKLLKGWYRKRKRVCLWILNLWYAVKALEEL

SEQ ID NO: 8767 - protein, 70 aa, Artificial Sequence
  Computer-generated peptide variant
LLRIFKRMFKRLKPTRNLKCQNLMGFYYLPLATRMERLLLLLKCTAERRIAKTTQGAAAASTMLMRRLAA

SEQ ID NO: 8768 - protein, 25 aa, Artificial Sequence
  Computer-generated peptide variant
FYKLIPRFWRRFKKCAKKSLLAGLD

SEQ ID NO: 8769 - protein, 66 aa, Artificial Sequence
  Computer-generated peptide variant
KYRLYRRIFRKLCSARHAYIKAAFIRGGIYLALRTNRLWEAGLDRRIRDLLRKEERTANCKLMLRA

SEQ ID NO: 8770 - protein, 21 aa, Artificial Sequence
  Computer-generated peptide variant
RWKFLPKLLRRFRRNCAKLAA

SEQ ID NO: 8771 - protein, 82 aa, Artificial Sequence
  Computer-generated peptide variant
FLKMIPKFLKWLHTRSALRRLAKRTWIKKDAMNLKKLKAACCLLLRAWCNDDCTALCDKYRRAHARACASLTARARVQRIKA

SEQ ID NO: 8772 - protein, 26 aa, Artificial Sequence
  Computer-generated peptide variant
RFRLFKKMLRRITRALARALIIAMQW

SEQ ID NO: 8773 - protein, 39 aa, Artificial Sequence
  Computer-generated peptide variant
KMRLLRKLLKKMHPKKTFARALLQTHSCRLKWALALVDG

SEQ ID NO: 8774 - protein, 93 aa, Artificial Sequence
  Computer-generated peptide variant
RLRLWCKLMKKFNKSAAYFLKYLKREFLAKVLLKFLYVKLRAKKAFMRVKLKIARRRASRKMRACTLSMFHIIATLSKRCCLARQMVGMWPAY

SEQ ID NO: 8775 - protein, 34 aa, Artificial Sequence
  Computer-generated peptide variant
LFRLYRKILKRLPHHWLRLRTKCAYYKGLLRNKR

SEQ ID NO: 8776 - protein, 32 aa, Artificial Sequence
  Computer-generated peptide variant
RLKFFSRLLRKIKRKFCARRMHLALVCDAKLN

SEQ ID NO: 8777 - protein, 42 aa, Artificial Sequence
  Computer-generated peptide variant
KFKFLTRLFRLLRKAKYLVLCADLRKHREPAVMLALDWFKAK

SEQ ID NO: 8778 - protein, 60 aa, Artificial Sequence
  Computer-generated peptide variant
KWRYLHRYMRWFQKLRLMLHAYRKRLDARAANSYRAAWRAALERKRNMQGSCYPLILKSA

SEQ ID NO: 8779 - protein, 47 aa, Artificial Sequence
  Computer-generated peptide variant
LLKLWKRYLKFLKTNKKRYALQTHQCAKTRNKRVKLLRLTDRVAVTR

SEQ ID NO: 8780 - protein, 38 aa, Artificial Sequence
  Computer-generated peptide variant
IFRLFRRFLKLLRKRQDKERLHRALNRLLWAAPKMPFD

SEQ ID NO: 8781 - protein, 37 aa, Artificial Sequence
  Computer-generated peptide variant
KLKWMRKLLRRLCKLTIYCLAHTAKRLDKAGRVVLLA

SEQ ID NO: 8782 - protein, 28 aa, Artificial Sequence
  Computer-generated peptide variant
YLKWLKKYLRFLRKAVQKKAATLKSNSW

SEQ ID NO: 8783 - protein, 28 aa, Artificial Sequence
  Computer-generated peptide variant
KMKLYKRWFKLYRRRGEAILYILLLPSR

SEQ ID NO: 8784 - protein, 27 aa, Artificial Sequence
  Computer-generated peptide variant
KWKLYPKWIRRWTRLKAAQSLYIASAR

SEQ ID NO: 8785 - protein, 34 aa, Artificial Sequence
  Computer-generated peptide variant
KFKLWKRMLKWLKRYLKGDGGMLFLTKLYKLFLE

SEQ ID NO: 8786 - protein, 52 aa, Artificial Sequence
  Computer-generated peptide variant
KFRMLNKILKFWQKTHKQELKRHVQGKPKLKRLFRFAARGTLLHTLARLRAL

SEQ ID NO: 8787 - protein, 60 aa, Artificial Sequence
  Computer-generated peptide variant
FFKLWHRWYRFINKDHALKAPKISANRRKLQLRKWAIEALKQLRADDKHKLRAPKQAKQD

SEQ ID NO: 8788 - protein, 32 aa, Artificial Sequence
  Computer-generated peptide variant
RMKFMRRIFRFWKNALALKAWALQLQKCSKRP

SEQ ID NO: 8789 - protein, 39 aa, Artificial Sequence
  Computer-generated peptide variant
KMKFIRRLMKKLRRKRAHGMAHLCQARAHLTGDPPKILL

SEQ ID NO: 8790 - protein, 79 aa, Artificial Sequence
  Computer-generated peptide variant
KLRLLNRLLRYFRKLAKLQDLAEVKWAKWFLQLLVWLDAKTERGLGWISALGAKADLYKAPCIWRKYAHRAKPKMDRIF

SEQ ID NO: 8791 - protein, 68 aa, Artificial Sequence
  Computer-generated peptide variant
RLKYWQKLLKILTKLKRCKNQASFHAPPWAYRLCSGRKRALYMIPRRFCTKLRKLTMDRLMMLKRARL

SEQ ID NO: 8792 - protein, 63 aa, Artificial Sequence
  Computer-generated peptide variant
YYRMFRRFIRKLKPANYWAKILCRLAGLARKLHQERRRACSAAKIKLCRMLERDARYNYICLR

SEQ ID NO: 8793 - protein, 57 aa, Artificial Sequence
  Computer-generated peptide variant
RWRWYRRLLKRWCNSAKPIRQAACRLATLHSKRHCLKAPLLAAPADRKGKKSRRMHE

SEQ ID NO: 8794 - protein, 59 aa, Artificial Sequence
  Computer-generated peptide variant
RLRMLRRLLRFFKCNHPHAALKLWIKLQACALKREKQATTKFRCANPMCQKRLVALKKL

SEQ ID NO: 8795 - protein, 74 aa, Artificial Sequence
  Computer-generated peptide variant
RLRLYRRFMRKLKCKANYLLKKAKWYKKCKRTQKILRAIEVMRYRALPLLENQCSKLQARAHDRAHALIALDAG

SEQ ID NO: 8796 - protein, 34 aa, Artificial Sequence
  Computer-generated peptide variant
RFRLLKKLLRRFRSLDGQKAYALMWLRFELDKYW

SEQ ID NO: 8797 - protein, 76 aa, Artificial Sequence
  Computer-generated peptide variant
KLRLLTKFWKRWKKFLISKRLEIASELTRLWAKFCWAHENHQDMAANGNYAKQLAAAADEKLAKKKKQLALKGRLR

SEQ ID NO: 8798 - protein, 41 aa, Artificial Sequence
  Computer-generated peptide variant
RLRLLNKFYKWLTKQVLLCKNSSKQALKAAKCHPWHAAERA

SEQ ID NO: 8799 - protein, 23 aa, Artificial Sequence
  Computer-generated peptide variant
KMKFLKKLLKLLSCCYALFVRQK

SEQ ID NO: 8800 - protein, 28 aa, Artificial Sequence
  Computer-generated peptide variant
LLRIMRRFLRKLKRNWLSLQRLWGLFDQ

SEQ ID NO: 8801 - protein, 31 aa, Artificial Sequence
  Computer-generated peptide variant
FFKLIKKYLRRLNTVRALRARATEILKLRRL

SEQ ID NO: 8802 - protein, 41 aa, Artificial Sequence
  Computer-generated peptide variant
RLRLWKKILKLYRNNLATNSFRSHAFLAWKQQTKANALKKA

SEQ ID NO: 8803 - protein, 47 aa, Artificial Sequence
  Computer-generated peptide variant
MFKYMRKFLKRLKHYRLWPACKRAKNKPFLKPPLKYMAMLAKLALNH

SEQ ID NO: 8804 - protein, 42 aa, Artificial Sequence
  Computer-generated peptide variant
LWKFYCKYWRKLQNFRKPEKRKRLLRFWLKLATKADFLLKKL

SEQ ID NO: 8805 - protein, 69 aa, Artificial Sequence
  Computer-generated peptide variant
RLKFLSKIWRFLRKKRALLVKRAPPNLPKYRDAYMPLKRPTLFQKICIFHHRARARLAPQKRLDIRFGL

SEQ ID NO: 8806 - protein, 31 aa, Artificial Sequence
  Computer-generated peptide variant
RLKFWPRLLRFIKRKLTLQACARAKYIYCFK

SEQ ID NO: 8807 - protein, 43 aa, Artificial Sequence
  Computer-generated peptide variant
KIKLMKRLLRRLKRRCDNMALQAQHMLAKKCKVPLRMVICAAP

SEQ ID NO: 8808 - protein, 38 aa, Artificial Sequence
  Computer-generated peptide variant
LLRLWKRLFRFWKRARLLCFLKVRRNMLPKAMRRRWFL

SEQ ID NO: 8809 - protein, 30 aa, Artificial Sequence
  Computer-generated peptide variant
ILKLMKRLLKRWTNKREVYLLKKLCPLRYL

SEQ ID NO: 8810 - protein, 49 aa, Artificial Sequence
  Computer-generated peptide variant
FWKLMTRLLRYMRRELIASHLARIWKRKLIACQKRFLIRAKLDAYENAY

SEQ ID NO: 8811 - protein, 34 aa, Artificial Sequence
  Computer-generated peptide variant
MLKILTKLFRKLPKGKLTKRRRPASHLGALCCVL

SEQ ID NO: 8812 - protein, 49 aa, Artificial Sequence
  Computer-generated peptide variant
KYKYLRRLLKYLKRYAAPWAAELSLFGCLKRLAKKNRHKQLFDSRKWSA

SEQ ID NO: 8813 - protein, 51 aa, Artificial Sequence
  Computer-generated peptide variant
YIRLFKRMFRYWKRLQLKLDAKMAPKAIGRAVRTPRAAQAKLKNMAKKYFM

SEQ ID NO: 8814 - protein, 44 aa, Artificial Sequence
  Computer-generated peptide variant
LLKYLTKWLKRLKTQAKPRNRVAAKKKLALKKARYKLYDGIELA

SEQ ID NO: 8815 - protein, 63 aa, Artificial Sequence
  Computer-generated peptide variant
IWKWLKKLFRLLKKKEVFFVRRLILLMKADYKIAKHAWLWRACLVLLNRFPAHLYKQHKHKAF

SEQ ID NO: 8816 - protein, 89 aa, Artificial Sequence
  Computer-generated peptide variant
RLKFMRKLIRKWKSIRIKARLARMMRSSNWAYVACAKKCADKGGKHIKVRAAKAATLHKRKTRAVALSWEALKNTGAVIRARLKMFKFC

SEQ ID NO: 8817 - protein, 51 aa, Artificial Sequence
  Computer-generated peptide variant
KLKYWRKFYKLWRRLIRQKSKDCRAGTLLKPSRKPNNRHCRRPAHAAWALL

SEQ ID NO: 8818 - protein, 35 aa, Artificial Sequence
  Computer-generated peptide variant
LLRILQRWLRKLKKTILQAVAMKRERKWKTLADAH

SEQ ID NO: 8819 - protein, 40 aa, Artificial Sequence
  Computer-generated peptide variant
RLRLLRRWLKRFSRLQSRELAKLIMFLACLARRCLKRKKD

SEQ ID NO: 8820 - protein, 75 aa, Artificial Sequence
  Computer-generated peptide variant
RLKLFKRLLKKLNRWRVNGPRERLEPRKKAALAHCRWAEEKKMVCADAARKVRALQRLHLANNLKRKGKERAVLR

SEQ ID NO: 8821 - protein, 40 aa, Artificial Sequence
  Computer-generated peptide variant
RFKLMCKWLRKYRPAEARLERTKAWIMMAGRKALICLSAW

SEQ ID NO: 8822 - protein, 49 aa, Artificial Sequence
  Computer-generated peptide variant
KIKLWTRWWKKWRRKHCPVKPMNRADLMLLKKLRHAQFLARKVAVARLA

SEQ ID NO: 8823 - protein, 35 aa, Artificial Sequence
  Computer-generated peptide variant
FLRFMCKFMKWLKKKAPRSDVLRALNRLRRRTLLM

SEQ ID NO: 8824 - protein, 22 aa, Artificial Sequence
  Computer-generated peptide variant
KLRFMRRIWKLLHRLKITAALN

SEQ ID NO: 8825 - protein, 20 aa, Artificial Sequence
  Computer-generated peptide variant
KIRWYSRLIKLLRHSLDRDA

SEQ ID NO: 8826 - protein, 61 aa, Artificial Sequence
  Computer-generated peptide variant
KWRMLRRYMRRWSKAFITRRLAKRAKCHASESEMSKRLGRACRRNKLKANARKHALIFAAL

SEQ ID NO: 8827 - protein, 42 aa, Artificial Sequence
  Computer-generated peptide variant
IMKLYQRYMRYLRTGLQRRAAARALWLAANFHVRAWRKKAAV

SEQ ID NO: 8828 - protein, 66 aa, Artificial Sequence
  Computer-generated peptide variant
KYKFWRKLLRMWRCQRIDPHLKLNTKLLKVKTKSLSAAFSQLGKTRWALLDLTVARKRPLLLFKKK

SEQ ID NO: 8829 - protein, 80 aa, Artificial Sequence
  Computer-generated peptide variant
YLKLMKRFLKRWPSEKKLGAYFQREKHMNKFTNWRLIGYSKLRLLWVAKQKWARLTRSRRLRDPNPAPAKLLPSKKLKKL

SEQ ID NO: 8830 - protein, 31 aa, Artificial Sequence
  Computer-generated peptide variant
KWRFLNKLWRFLKSCLLAYALTRARKALEWI

SEQ ID NO: 8831 - protein, 32 aa, Artificial Sequence
  Computer-generated peptide variant
FLRLLSRFLKMFKKRHAKSTARLHDIKAKDTI

SEQ ID NO: 8832 - protein, 50 aa, Artificial Sequence
  Computer-generated peptide variant
KLRIFHKLLRRFRKLALKFLKKPAVNQHYKGTLMERPKDLELALVRVGAK

SEQ ID NO: 8833 - protein, 20 aa, Artificial Sequence
  Computer-generated peptide variant
RLKLLKKWWKFLRNKDLHCI

SEQ ID NO: 8834 - protein, 69 aa, Artificial Sequence
  Computer-generated peptide variant
KLRLMKKMFKILNQVKRRLGAHRQLKLLKWFKSKAGASRRAMWVYYGILALRWQLAKLQQHKIRKANLH

SEQ ID NO: 8835 - protein, 52 aa, Artificial Sequence
  Computer-generated peptide variant
RWKLWKKIFKRFHTLARQILKESKIADKAKRRFLWNLPATCATRYLGLAAAE

SEQ ID NO: 8836 - protein, 20 aa, Artificial Sequence
  Computer-generated peptide variant
MLKFYQRLWRWLKRRINAPA

SEQ ID NO: 8837 - protein, 51 aa, Artificial Sequence
  Computer-generated peptide variant
KYRLMRKMLKKFCCSLKLAQHVANLRKAHNAKADPWAAYAWRRCPNPKKRR

SEQ ID NO: 8838 - protein, 38 aa, Artificial Sequence
  Computer-generated peptide variant
RLRWYQKWFKKMHKAALRLRLLAHKQKRWCVPTKLLLF

SEQ ID NO: 8839 - protein, 32 aa, Artificial Sequence
  Computer-generated peptide variant
LLRMLNKMFKKLRNLRSITKASARPRSARNLN

SEQ ID NO: 8840 - protein, 36 aa, Artificial Sequence
  Computer-generated peptide variant
RYRWWKRLLRLLRHCSNELRRALLLLQCKRGSEHGL

SEQ ID NO: 8841 - protein, 25 aa, Artificial Sequence
  Computer-generated peptide variant
MLKWLKRFLKRYKKLPEIDNSLVLL

SEQ ID NO: 8842 - protein, 36 aa, Artificial Sequence
  Computer-generated peptide variant
RLRFMKRYLRKWRSALCKIRELLIRRADQGEACLWI

SEQ ID NO: 8843 - protein, 30 aa, Artificial Sequence
  Computer-generated peptide variant
KWRFLQRFIKLMRKAAKPDLMLKPRKALCL

SEQ ID NO: 8844 - protein, 36 aa, Artificial Sequence
  Computer-generated peptide variant
KLRWFKRWLRLITKRMAAQHVANLRAAQKRRKSAHL

SEQ ID NO: 8845 - protein, 97 aa, Artificial Sequence
  Computer-generated peptide variant
RLKWIKRLFRKLHRHAACQERSRQLAFLKYLKTATRTTKHAYAAMIELKAVTVKDGAADGYRPALTLLRLEWKLLEGAPKARCSAEKKAVFFKMKRR

SEQ ID NO: 8846 - protein, 50 aa, Artificial Sequence
  Computer-generated peptide variant
RLRLLRRLLKRLQQTLAPHFTADQRRRLNRYCVAGAKEEPFICALAIKAT

SEQ ID NO: 8847 - protein, 92 aa, Artificial Sequence
  Computer-generated peptide variant
FWRFYKRYLKRYPKKAMARRRSKMFKALNLYYLKAIALYDNNAATGSSACWDYQACASLQGLLAKLRKKRVKRRPFRSVKFKKLLLTLLEMK

SEQ ID NO: 8848 - protein, 30 aa, Artificial Sequence
  Computer-generated peptide variant
ILRIISRMFRILKRLHALTRLAKTKGLLAL

SEQ ID NO: 8849 - protein, 39 aa, Artificial Sequence
  Computer-generated peptide variant
RLKILRKIIRFMKKGYKVRRRLCAAALDWHCPGDYAKLL

SEQ ID NO: 8850 - protein, 21 aa, Artificial Sequence
  Computer-generated peptide variant
RFRLLNKIWRKFSRLLEYLMA

SEQ ID NO: 8851 - protein, 43 aa, Artificial Sequence
  Computer-generated peptide variant
RLRYMNRYFKRFCRWLTWRVLILWRRAATLSPNRAWRLRLKKD

SEQ ID NO: 8852 - protein, 36 aa, Artificial Sequence
  Computer-generated peptide variant
YFKMLKRFWRKWRHAAAAPAKDAGDKHNAAATKDQL

SEQ ID NO: 8853 - protein, 23 aa, Artificial Sequence
  Computer-generated peptide variant
KLRIIRKWLRKMRCLLKRAALNL

SEQ ID NO: 8854 - protein, 28 aa, Artificial Sequence
  Computer-generated peptide variant
RYKILKRLYRKFQKAYHGQLAASLPRKI

SEQ ID NO: 8855 - protein, 30 aa, Artificial Sequence
  Computer-generated peptide variant
LMRFYSRLWKKFPHRRAAPRNDAAKACAAW

SEQ ID NO: 8856 - protein, 44 aa, Artificial Sequence
  Computer-generated peptide variant
YLKYFKKLLRLWKHRLMRQKKHEGELILAWKLRLLIARWDKLCR

SEQ ID NO: 8857 - protein, 75 aa, Artificial Sequence
  Computer-generated peptide variant
LLRLFPRLYRRLPKFRLQGACKRWCAPLRKKKLDHSQDQEKDQLDTLWKTAFILWAKIKEAELALKMKAGLQLRL

SEQ ID NO: 8858 - protein, 31 aa, Artificial Sequence
  Computer-generated peptide variant
LFKFYRRLLRKFRCKRALLDIFLTKAVAYET

SEQ ID NO: 8859 - protein, 39 aa, Artificial Sequence
  Computer-generated peptide variant
RWKLWKKLLKLYKHKNVLQRLLAEARRILQKLKGHKKLR

SEQ ID NO: 8860 - protein, 20 aa, Artificial Sequence
  Computer-generated peptide variant
LFRLLRKYLKMIRRMRPSLT

SEQ ID NO: 8861 - protein, 38 aa, Artificial Sequence
  Computer-generated peptide variant
RFRLLKRMLRLFRCADRLNKRATYNLIQGLLAKSRRKT

SEQ ID NO: 8862 - protein, 26 aa, Artificial Sequence
  Computer-generated peptide variant
MFRILKRLFKRLRTKLGCLAKHLLAM

SEQ ID NO: 8863 - protein, 42 aa, Artificial Sequence
  Computer-generated peptide variant
RLKMLRKFLRKWTRASFKAAGAAKQHLCWMAASPRYRRVTIK

SEQ ID NO: 8864 - protein, 30 aa, Artificial Sequence
  Computer-generated peptide variant
RLRYLKRWLKKLPHPDRFTWAAKAAAWQKD

SEQ ID NO: 8865 - protein, 37 aa, Artificial Sequence
  Computer-generated peptide variant
FLKYFRKILKLFNNHAAWRTKLKNILLASWLHLLKRK

SEQ ID NO: 8866 - protein, 41 aa, Artificial Sequence
  Computer-generated peptide variant
KWKMICRIYRRLSKRGRALPARALKAITVPMFVTRAERARA

SEQ ID NO: 8867 - protein, 20 aa, Artificial Sequence
  Computer-generated peptide variant
KMRFLRRFLRRLRCYITHAA

SEQ ID NO: 8868 - protein, 66 aa, Artificial Sequence
  Computer-generated peptide variant
LLKYMRKLWKLISSGRAAEHRLIVKRLMRLSAALEARKYTFQRDCLAQHIRRKMGALCYAIKKKTK

SEQ ID NO: 8869 - protein, 99 aa, Artificial Sequence
  Computer-generated peptide variant
WIKLWRKLFKFLRKTRLLSPHARTAKKYARPACVHYRAFLLMAMENRPRKIAGYELNNALKDRQMYKLARKKSHTRHKFRRCFTAILTPKLARRAKLRS

SEQ ID NO: 8870 - protein, 78 aa, Artificial Sequence
  Computer-generated peptide variant
KLRIMKRLLRLLQKIAAQVHWKNALKKKSALRLLRLLIQFKALVALRVLWWAVATYRKIEFAQAGGLMKFKAKANKKR

SEQ ID NO: 8871 - protein, 26 aa, Artificial Sequence
  Computer-generated peptide variant
MYKYLSRLMRWLQSARLLARLFKCRR

SEQ ID NO: 8872 - protein, 65 aa, Artificial Sequence
  Computer-generated peptide variant
KYKILRKLLKMLKKPKKMNLWKLAMSAQKMSHRMLKRTASIRITANKAKCVSKRQARRLLQKMFA

SEQ ID NO: 8873 - protein, 82 aa, Artificial Sequence
  Computer-generated peptide variant
KWKILKRLLKFYRQADCGILFLKACAKALKTLKILLKDRPCRKFIALKHKKVFYDRQRRLQPKQHWKAMIAIPKAAIKHHKK

SEQ ID NO: 8874 - protein, 20 aa, Artificial Sequence
  Computer-generated peptide variant
LLRFFPKLLRMFTKAGARGR

SEQ ID NO: 8875 - protein, 38 aa, Artificial Sequence
  Computer-generated peptide variant
LWRLIKRFFKKIHKLLNTREPALLTLKLRKRADRRMAP

SEQ ID NO: 8876 - protein, 30 aa, Artificial Sequence
  Computer-generated peptide variant
LLKFLKKLLRFLKKKKLCSAQQRACAVDKV

SEQ ID NO: 8877 - protein, 36 aa, Artificial Sequence
  Computer-generated peptide variant
KLRIWNRLWRRFNKLLLFLLSKIALATGRCTYRKLK

SEQ ID NO: 8878 - protein, 74 aa, Artificial Sequence
  Computer-generated peptide variant
LFKLLTRYLRRLRKKKKLYGLADTIAILKMGNDLKKDQANSWRRRKAKSEHDLRLAHVKSLVAKILAMNVVHAC

SEQ ID NO: 8879 - protein, 49 aa, Artificial Sequence
  Computer-generated peptide variant
MIKLIKKLIKRIQKNMKYSKCPRQAVKDAALALAYEAKKARPKHLHRAE

SEQ ID NO: 8880 - protein, 56 aa, Artificial Sequence
  Computer-generated peptide variant
KLKMFKRILKLFRRAAAACKARVIALIKLNCESEGHAMPRMQRIARLALCLKVKNC

SEQ ID NO: 8881 - protein, 29 aa, Artificial Sequence
  Computer-generated peptide variant
YMRLYSRMLKIIKKNLNAVATKLAHKCKA

SEQ ID NO: 8882 - protein, 30 aa, Artificial Sequence
  Computer-generated peptide variant
IIKILCKLLKILRKWLTAIYKLMKHRLAHM

SEQ ID NO: 8883 - protein, 32 aa, Artificial Sequence
  Computer-generated peptide variant
KYKFLPRLFKLIRRKLDRHSAWLKAITGAKKL

SEQ ID NO: 8884 - protein, 100 aa, Artificial Sequence
  Computer-generated peptide variant
RYKMLRRIMRRLTKKFAWCWMLPRRERAKKRALPVYLIALAFKKALLACALEALYDANFLAPLKRAMNAKMRDALLVLRTHGLAVLKKFKDTNMWYYKTK

SEQ ID NO: 8885 - protein, 23 aa, Artificial Sequence
  Computer-generated peptide variant
IFKLLKKFLRRLTCQQPKRLAYC

SEQ ID NO: 8886 - protein, 49 aa, Artificial Sequence
  Computer-generated peptide variant
RFRYYRRWYKKWKKLIAGILAARDNRRSWKALYIKLLIKAWANCRLYDM

SEQ ID NO: 8887 - protein, 34 aa, Artificial Sequence
  Computer-generated peptide variant
KLRLIKRLYKRICCTAAVKMKIWAVQVLKALQHA

SEQ ID NO: 8888 - protein, 25 aa, Artificial Sequence
  Computer-generated peptide variant
RLRFFRRLLRLLHRMLKYATYMDYD

SEQ ID NO: 8889 - protein, 26 aa, Artificial Sequence
  Computer-generated peptide variant
KLRLFRKYLRKMRRFKSRTAAAALNM

SEQ ID NO: 8890 - protein, 47 aa, Artificial Sequence
  Computer-generated peptide variant
WFRYLHRLMRLLNKRARAGAGAWMERSTIAVLRCLRLRANACYYKEA

SEQ ID NO: 8891 - protein, 34 aa, Artificial Sequence
  Computer-generated peptide variant
LYRLYRKLMKFLRKALLVNRITEHAILKRSKYQA

SEQ ID NO: 8892 - protein, 67 aa, Artificial Sequence
  Computer-generated peptide variant
FFKMISKFYKKIKSQFALLLLRKKCADMARLRFCGLVAAFSNTRCLWRAHLSHRARRRTAKKDLVLL

SEQ ID NO: 8893 - protein, 20 aa, Artificial Sequence
  Computer-generated peptide variant
WIRMLKRLLKLFRKAIAWEQ

SEQ ID NO: 8894 - protein, 68 aa, Artificial Sequence
  Computer-generated peptide variant
LWKYFKRMWRRLRRAWQGLKLRYLWKRGAALAAGYLKARCRIAKAQAIMKLKYHRRAKGGTGFAHVIM

SEQ ID NO: 8895 - protein, 30 aa, Artificial Sequence
  Computer-generated peptide variant
MFKLFKKYLKKMRQALKLAKKAHRFLECED

SEQ ID NO: 8896 - protein, 38 aa, Artificial Sequence
  Computer-generated peptide variant
KLKYYHKIMRLLQRLAKLKRWTRRVFGAVGDHALLKHL

SEQ ID NO: 8897 - protein, 41 aa, Artificial Sequence
  Computer-generated peptide variant
MIKLIRKYWKRLRRPTCKHLALRAMRLKTLKIRLLARYFAC

SEQ ID NO: 8898 - protein, 64 aa, Artificial Sequence
  Computer-generated peptide variant
LWKFINRLLRRFHRHKLDFRLVLCCMLKRKLQRANRYVLWWMIKDRKILWKRLDLDAPEKARRA

SEQ ID NO: 8899 - protein, 70 aa, Artificial Sequence
  Computer-generated peptide variant
LLRFLRKLLKRYRRPPERKDLEAANCTTLGKAGLNLARMRHRFARALMAEKHAYLDTIRVDRLAFLKTNV

SEQ ID NO: 8900 - protein, 21 aa, Artificial Sequence
  Computer-generated peptide variant
KLKLLRRLLKRFHPTHDTCML

SEQ ID NO: 8901 - protein, 29 aa, Artificial Sequence
  Computer-generated peptide variant
YLRLMKKWFKKIHKAKFLAFIHLDAVLLD

SEQ ID NO: 8902 - protein, 82 aa, Artificial Sequence
  Computer-generated peptide variant
RLKLLRKFWKKLCKAERFAGAVAKKSTSLKNIARLATARWWRRSQIKSRIFKAAKKANECWFRYSAAYQILEKRKLPPLFKV

SEQ ID NO: 8903 - protein, 33 aa, Artificial Sequence
  Computer-generated peptide variant
LMKLFKKLFRRMQKRDRGSLLCLMAKAAETALK

SEQ ID NO: 8904 - protein, 49 aa, Artificial Sequence
  Computer-generated peptide variant
RLKLMRKWIKKLRKARTAAFLLLWCRFEALPPYKYHRYPDKLKKYRLLF

SEQ ID NO: 8905 - protein, 34 aa, Artificial Sequence
  Computer-generated peptide variant
KLKLLTRLIRLLRRLKARWQARILFAKKAVLGML

SEQ ID NO: 8906 - protein, 33 aa, Artificial Sequence
  Computer-generated peptide variant
LFKLIKKLFRFLQKVYKAAAGKNYYKRRQVLNA

SEQ ID NO: 8907 - protein, 33 aa, Artificial Sequence
  Computer-generated peptide variant
LFRLWCKMLRKLHKALNLRAKWMGYTACKKIML

SEQ ID NO: 8908 - protein, 64 aa, Artificial Sequence
  Computer-generated peptide variant
RLKIFSKLLRMFKKDRRLENLQKMLRWARLRKEVGLRKIAPACMAARAMRTAKKQLCRDLACTT

SEQ ID NO: 8909 - protein, 21 aa, Artificial Sequence
  Computer-generated peptide variant
RWRWFRRLLRRMKTLALKVAG

SEQ ID NO: 8910 - protein, 47 aa, Artificial Sequence
  Computer-generated peptide variant
RLRLWRKFFKFMRRLILRPKKFMRSAALKLGEPRQRQIQLAMLKTHH

SEQ ID NO: 8911 - protein, 83 aa, Artificial Sequence
  Computer-generated peptide variant
KLKLFKRFLRRWRKFMGGKRKANAMIDMIMRLLLLPWRRWAVRKPPKERNRWKLKELAQKKLWLRALHLAGLRHAWPCLHKYT

SEQ ID NO: 8912 - protein, 40 aa, Artificial Sequence
  Computer-generated peptide variant
LFKLLKKWLKYLRCMLCREAKFLAAPRNDLARWAGTNSQW

SEQ ID NO: 8913 - protein, 23 aa, Artificial Sequence
  Computer-generated peptide variant
LMRLLQRILKRMKKAVIRTHRLL

SEQ ID NO: 8914 - protein, 45 aa, Artificial Sequence
  Computer-generated peptide variant
RLRFFCRLLKKFTKGAAMNTLNKHKLNEFCGRSLLKIKAWAAQKR

SEQ ID NO: 8915 - protein, 23 aa, Artificial Sequence
  Computer-generated peptide variant
WLKFLRKWWRILRRWLLTARHNK

SEQ ID NO: 8916 - protein, 51 aa, Artificial Sequence
  Computer-generated peptide variant
RFKLFPRLLRKFKRKRCRALLAMIGRPCKAGLPAAPQHKDVHRTLLRLQII

SEQ ID NO: 8917 - protein, 28 aa, Artificial Sequence
  Computer-generated peptide variant
RLKFFCRFLRRWRRLEHKHLLLIATTAK

SEQ ID NO: 8918 - protein, 80 aa, Artificial Sequence
  Computer-generated peptide variant
KLKLFKKIMKRLCTRILTRAGPARVEAYNMALLRKWKNPVFVWRRDDLKRRKHDFLLLAYASKDAHKLLNAAYYHRLCRQ

SEQ ID NO: 8919 - protein, 35 aa, Artificial Sequence
  Computer-generated peptide variant
YLRLLCRILKFLRSIWNKMGAVRRLRLRKKAARLQ

SEQ ID NO: 8920 - protein, 86 aa, Artificial Sequence
  Computer-generated peptide variant
LFKYLRRLWRMYRRADKLRMCLKLQMNKKLKNGAWRKKCLNQMAPLIAAERHALRIKFFRAKRWLTSWRAAAKVRMIMCFRAGMSR

SEQ ID NO: 8921 - protein, 30 aa, Artificial Sequence
  Computer-generated peptide variant
RLKFMPRLFKFLQTARCKALLNRIRLLTLF

SEQ ID NO: 8922 - protein, 24 aa, Artificial Sequence
  Computer-generated peptide variant
KLRLFTRLFRRFPRFWLDDAIKAK

SEQ ID NO: 8923 - protein, 40 aa, Artificial Sequence
  Computer-generated peptide variant
MIKFLHRLLRLFRRHKAKKADWSYKRAAYQCLALRALYAF

SEQ ID NO: 8924 - protein, 49 aa, Artificial Sequence
  Computer-generated peptide variant
YLRMISKLIRLLNQKEKKLLARIRAKLLRLRRGKKQSLQLKAVLVDSAG

SEQ ID NO: 8925 - protein, 66 aa, Artificial Sequence
  Computer-generated peptide variant
KMKLFKKLMKKLKKKVKDAKAKQVLNLASLWKLRQRHEAADSAAKWEKLHLFSFRSASCPRPKNNT

SEQ ID NO: 8926 - protein, 41 aa, Artificial Sequence
  Computer-generated peptide variant
WLKLMKRLYRRMKKLMWMPQRAKKDAKEYILKRSGNLLSLN

SEQ ID NO: 8927 - protein, 41 aa, Artificial Sequence
  Computer-generated peptide variant
KLKLIKRLYKKIRRAGAQAVPWAELTWLLELCHLAFFKMCK

SEQ ID NO: 8928 - protein, 37 aa, Artificial Sequence
  Computer-generated peptide variant
RLKWLSRLMRKLRRRALSRAVLSCDAAWVWLHRPRHY

SEQ ID NO: 8929 - protein, 35 aa, Artificial Sequence
  Computer-generated peptide variant
LWKWWNKLLKKFKCNILKLLLQYATKEFIRILRRK

SEQ ID NO: 8930 - protein, 42 aa, Artificial Sequence
  Computer-generated peptide variant
RLRFIPKLLRILRQLGIKALKAEKTRRRDAKAGAGYWPLAKR

SEQ ID NO: 8931 - protein, 59 aa, Artificial Sequence
  Computer-generated peptide variant
RLKFLRRFLKIFSCVCKNTKGAKKYNDLLARVAARNLRLVNKYKRRDRISLGPALKDIA

SEQ ID NO: 8932 - protein, 27 aa, Artificial Sequence
  Computer-generated peptide variant
LLRWFRKIIRYLRPARKSELCKLALLK

SEQ ID NO: 8933 - protein, 35 aa, Artificial Sequence
  Computer-generated peptide variant
RMKYLKRLYKFIRNPRKDYILRILESLNRALANLA

SEQ ID NO: 8934 - protein, 43 aa, Artificial Sequence
  Computer-generated peptide variant
YLRWLQKLLRFIKRFRMAKYRRKYLTLGACNFPCTAKLRWLKW

SEQ ID NO: 8935 - protein, 25 aa, Artificial Sequence
  Computer-generated peptide variant
LFRWLRRFLKRLRSALQPFRREKLA

SEQ ID NO: 8936 - protein, 40 aa, Artificial Sequence
  Computer-generated peptide variant
FLRLWKRYWRFWKKSACRLARHLNLRAHRQLLALSAHQWN

SEQ ID NO: 8937 - protein, 27 aa, Artificial Sequence
  Computer-generated peptide variant
RYKYYRKFLRLYKHYRAAAQLSVNYAA

SEQ ID NO: 8938 - protein, 21 aa, Artificial Sequence
  Computer-generated peptide variant
LWRMMHRILRIWRKAPAARRE

SEQ ID NO: 8939 - protein, 43 aa, Artificial Sequence
  Computer-generated peptide variant
KLRIFKKWWRYFRKISLVWKKARSEFQRARLCLAVLDKLYCLL

SEQ ID NO: 8940 - protein, 56 aa, Artificial Sequence
  Computer-generated peptide variant
KFRIFRRYLRKYRKRAQPAIAMHGKCKLLCLARRDEFHMELYRAHLRAAWACLLLS

SEQ ID NO: 8941 - protein, 40 aa, Artificial Sequence
  Computer-generated peptide variant
YFRLYKKFMKWIKSLCKLALRLQCRQALAAGAARLKKGLM

SEQ ID NO: 8942 - protein, 38 aa, Artificial Sequence
  Computer-generated peptide variant
RLKFLKKLLKIFHKLEAGKAKRMKSCRCLLARAKAKEV

SEQ ID NO: 8943 - protein, 90 aa, Artificial Sequence
  Computer-generated peptide variant
KLRIFSKLFKFLHRAAREDTLLACHKFCAYALTYLNAGRWLRRAYLRVLGGRVATGRKKHAKVRAYRYKKLFRAKLRVAFMFNQARRVWC

SEQ ID NO: 8944 - protein, 46 aa, Artificial Sequence
  Computer-generated peptide variant
LIRWIKKLLKFWKNDPWAAWLAKAKAKRLAYGHTLDGFRARKLQSP

SEQ ID NO: 8945 - protein, 94 aa, Artificial Sequence
  Computer-generated peptide variant
RYKFLHKMYRKLKQHLIAWGLARCLPNRIRIMLVLRQRYAPLWFLMKLARKRAKNFAALRRTYAAAWRNRHYMLRAVRQEMDQLARNKARKKTT

SEQ ID NO: 8946 - protein, 24 aa, Artificial Sequence
  Computer-generated peptide variant
LLKLISRLMKRFTNGSLVRANRRR

SEQ ID NO: 8947 - protein, 73 aa, Artificial Sequence
  Computer-generated peptide variant
RMRLLQRLLKRFSRLACEALVKKRKKAGYIYLRLSTLRFRALLPKKRWNSEYLKRKSNKSAQANKSKNLARML

SEQ ID NO: 8948 - protein, 27 aa, Artificial Sequence
  Computer-generated peptide variant
MWRLWRKLFKRFCPCLKLKLRASAVAE

SEQ ID NO: 8949 - protein, 23 aa, Artificial Sequence
  Computer-generated peptide variant
KLKLLPKFFKLYTKFLRYGKAQP

SEQ ID NO: 8950 - protein, 54 aa, Artificial Sequence
  Computer-generated peptide variant
KFRFLCRLMKLFKKLQLRKGLRAQCALLLRADDNENLRKYRRNFKWKPTMYCLV

SEQ ID NO: 8951 - protein, 40 aa, Artificial Sequence
  Computer-generated peptide variant
LFKLWSRFYKFFNKDRPKAALRAFSLWWRWTARKAKLCLL

SEQ ID NO: 8952 - protein, 39 aa, Artificial Sequence
  Computer-generated peptide variant
LMKWWRKLWRRLSCVCAGAKKALMPTAIGARKAKRKRKL

SEQ ID NO: 8953 - protein, 33 aa, Artificial Sequence
  Computer-generated peptide variant
KYRWLRRLFRLLRSFCKYHLRRMARVAQEFFLK

SEQ ID NO: 8954 - protein, 45 aa, Artificial Sequence
  Computer-generated peptide variant
RIRLFKKLLKFLRHLGNLRTHAAWIWASMKEHWKELLLIRNLRRK

SEQ ID NO: 8955 - protein, 28 aa, Artificial Sequence
  Computer-generated peptide variant
KIKLLRRFWRWLKRNNARLMQALAKPRW

SEQ ID NO: 8956 - protein, 42 aa, Artificial Sequence
  Computer-generated peptide variant
FIRLWKKFIKKLKSYLKLDLLRVRELRYSKLFMAKKLQYWNR

SEQ ID NO: 8957 - protein, 53 aa, Artificial Sequence
  Computer-generated peptide variant
FMKMWKRFMRLMKKHPKAFRKGRRFRAYRKLLALAADANLCLLHFLPYIAQAA

SEQ ID NO: 8958 - protein, 20 aa, Artificial Sequence
  Computer-generated peptide variant
KMRFWKRYLRRLTKLYQPAA

SEQ ID NO: 8959 - protein, 23 aa, Artificial Sequence
  Computer-generated peptide variant
LLRMLRKLLRFYRSAWRLAHTWD

SEQ ID NO: 8960 - protein, 42 aa, Artificial Sequence
  Computer-generated peptide variant
LLKLFKRYMRKLHRVRMRGKACGKAHRIQAKRAWAWCLEYRL

SEQ ID NO: 8961 - protein, 27 aa, Artificial Sequence
  Computer-generated peptide variant
KWRFYSRILRYLQQKGAAARGLLRRLH

SEQ ID NO: 8962 - protein, 23 aa, Artificial Sequence
  Computer-generated peptide variant
KYRWLPRFFRLFNKAADASLKAQ

SEQ ID NO: 8963 - protein, 37 aa, Artificial Sequence
  Computer-generated peptide variant
FLRLWCRLFKRLCKRLAKRHLGACDWMAWTDAALKKA

SEQ ID NO: 8964 - protein, 70 aa, Artificial Sequence
  Computer-generated peptide variant
KYRIWCKLIRRWKHWLSKFPKKVIARFCYAAAPRRLTCKLKKVRMLRMILPARACATALRLQKNSLKKIR

SEQ ID NO: 8965 - protein, 76 aa, Artificial Sequence
  Computer-generated peptide variant
RYRILKRFLRRWRTDYHSRTSGRSLFYYAVQQARKANKRTRGNNVLLRLSKLAKKALLGSCLLLPANKLHRKQSRL

SEQ ID NO: 8966 - protein, 40 aa, Artificial Sequence
  Computer-generated peptide variant
LFKFMTRFFRKWRRLKRQRCANAAADACALHHPASLLDRE

SEQ ID NO: 8967 - protein, 70 aa, Artificial Sequence
  Computer-generated peptide variant
LLKLLTKFWKRYRKTRKTGYATCSLRDARCAVARARINAKRRMSRKQAKGRWGFRFLVLWLAKMKMKDPY

SEQ ID NO: 8968 - protein, 66 aa, Artificial Sequence
  Computer-generated peptide variant
KLRWLNRLWKLWKRLAQKLKLNWLQTHMKTARTYAMASNQGDARKARKAAMRLVVARQLMWKESLS

SEQ ID NO: 8969 - protein, 65 aa, Artificial Sequence
  Computer-generated peptide variant
KLRLYCRLLRMLHRKFKQSWAFAAAFQGLHQGKVKNSRAKDRAWRCRKTHSFKAAAMESLRLRRK

SEQ ID NO: 8970 - protein, 20 aa, Artificial Sequence
  Computer-generated peptide variant
RLRYFQKYWRKMKCVLAALE

SEQ ID NO: 8971 - protein, 79 aa, Artificial Sequence
  Computer-generated peptide variant
FYRILQKLWKKMKKARWLAKEKKRLKEWLYVVHAFACEHSPRNALIAWCEKMHAVEPLRRKRLASAAKFLSLRLLLMRE

SEQ ID NO: 8972 - protein, 20 aa, Artificial Sequence
  Computer-generated peptide variant
RFKIFTKLLRYFRPRLAAAK

SEQ ID NO: 8973 - protein, 69 aa, Artificial Sequence
  Computer-generated peptide variant
LLKMFKRLFKLLRHRPAYAFRDREYLPRLTARGWGRFLKKDKWLARAFFKDKTLRKKDHFLTLKCKLYW

SEQ ID NO: 8974 - protein, 33 aa, Artificial Sequence
  Computer-generated peptide variant
LFRILKKMLRRLRKRPFLKWIGLRLALKDKQLR

SEQ ID NO: 8975 - protein, 49 aa, Artificial Sequence
  Computer-generated peptide variant
YLRWFQRFLRKLKTKPNAQILDKLRADLCRDAWVGRLKALKTVGKRLLH

SEQ ID NO: 8976 - protein, 26 aa, Artificial Sequence
  Computer-generated peptide variant
RLRLLSRLLRRFCPHCRYKWLAAFRA

SEQ ID NO: 8977 - protein, 35 aa, Artificial Sequence
  Computer-generated peptide variant
KYKLMKRFFRFLRQRTWADLHKLAKDPTLKLYKAL

SEQ ID NO: 8978 - protein, 25 aa, Artificial Sequence
  Computer-generated peptide variant
KLRWYKKLWKYWKQLRKQHELCALF

SEQ ID NO: 8979 - protein, 23 aa, Artificial Sequence
  Computer-generated peptide variant
ILRWFSKLFRLMHRALKPTTKLR

SEQ ID NO: 8980 - protein, 79 aa, Artificial Sequence
  Computer-generated peptide variant
RFKIFRRWLRKFRKLAHLKELANHLNKYAIWLEITMSVGKKKRKPSCNALPLDRRLTLLRAAYMRDLWREALDLAEAKP

SEQ ID NO: 8981 - protein, 33 aa, Artificial Sequence
  Computer-generated peptide variant
LYRLLKKYIRFLKRLKVLMLCRLWVLYRKLDHT

SEQ ID NO: 8982 - protein, 26 aa, Artificial Sequence
  Computer-generated peptide variant
RLRLWHRLYRKLKHIKGALMAELWTR

SEQ ID NO: 8983 - protein, 36 aa, Artificial Sequence
  Computer-generated peptide variant
FLRILRRMIRKFRREAWCPLRKARRTVLQRQLALWL

SEQ ID NO: 8984 - protein, 67 aa, Artificial Sequence
  Computer-generated peptide variant
WLRYLKRLWRLYRNLKNVKRSIPLVWWKSCARLTSAAGRRLLRKICLFDLRDKKERSIKAATEKAAF

SEQ ID NO: 8985 - protein, 50 aa, Artificial Sequence
  Computer-generated peptide variant
KIRLFKRLWRKLCKGALGALKWNEEKDLERKRAALDKMVAAFGRKWLRPF

SEQ ID NO: 8986 - protein, 20 aa, Artificial Sequence
  Computer-generated peptide variant
FIRLLRRLFKLLSRLLRDRP

SEQ ID NO: 8987 - protein, 86 aa, Artificial Sequence
  Computer-generated peptide variant
KLKLWKRYLRRFKRLLKAAKNRPRAHKQNLYLKHKAWVRTSKHLRAHEAVPWARLQKRLFCCVFNPRLIRVAMYHREALKIKMEAS

SEQ ID NO: 8988 - protein, 41 aa, Artificial Sequence
  Computer-generated peptide variant
LLRMMPRLWKRLPRRMFLNPWQRAQKFAIKHAKKLRKKLAA

SEQ ID NO: 8989 - protein, 41 aa, Artificial Sequence
  Computer-generated peptide variant
KIRLFKRWFRLIRSFCGLFLGGALNTAKLAKEKRFVGALKA

SEQ ID NO: 8990 - protein, 50 aa, Artificial Sequence
  Computer-generated peptide variant
KMKLLNRLFRRLKRYCKEMNIAKSQMLFCLKAASVWALGARRAARDRRGM

SEQ ID NO: 8991 - protein, 80 aa, Artificial Sequence
  Computer-generated peptide variant
KWKLFHRYYKKMCNMVYARKKKHLLLPAPELQPSRVGVKAMALKCTSLLEYASKVRKHAARAPRAARCRAWANKGLARLA

SEQ ID NO: 8992 - protein, 71 aa, Artificial Sequence
  Computer-generated peptide variant
WFRWIPRLFRFFSKIRRLPLEPIRSKLALKKNAAWIKLSLAKNLSLRPKKRRARGCGSKNEHLTRKAAKAL

SEQ ID NO: 8993 - protein, 43 aa, Artificial Sequence
  Computer-generated peptide variant
MMRLLKRLFRYWKPKIILEAEKNLRARRAKLWALALPKARFKL

SEQ ID NO: 8994 - protein, 83 aa, Artificial Sequence
  Computer-generated peptide variant
KWKLYKKLMRRLTPAMPDLLLLMRCRAARAQKNRAADWAAECSGIRAAPEFWDIKERLRRRKNATQRAKAYDYKKIRCRSKRH

SEQ ID NO: 8995 - protein, 76 aa, Artificial Sequence
  Computer-generated peptide variant
KWRWIRKLYKLLKSIRTLLRAMLFKLIIRILHLETHKMLKILFYKLLMLDRWETLCILAEFPALHRDLIPLKKRKK

SEQ ID NO: 8996 - protein, 25 aa, Artificial Sequence
  Computer-generated peptide variant
RIRWWPKLFRRLNRGFAILLFKRIA

SEQ ID NO: 8997 - protein, 26 aa, Artificial Sequence
  Computer-generated peptide variant
LIKFLRKLMRLMKKMKAAEVIRRAQF

SEQ ID NO: 8998 - protein, 76 aa, Artificial Sequence
  Computer-generated peptide variant
KMKFWRKWLKFFRCLRDAKPRTHFISMKKCKNHWAARVLATRGCITCRKLVLFYRLELLQHAKTKLRLARHAAKKA

SEQ ID NO: 8999 - protein, 80 aa, Artificial Sequence
  Computer-generated peptide variant
RWKMMKRLLKILKNWLRAATHQMRGLLRNLHARRNRNKCSAANKRFPTAPLGRDAAREKPFEHLEKAKRLRDRMMLLAPF

SEQ ID NO: 9000 - protein, 34 aa, Artificial Sequence
  Computer-generated peptide variant
KMRLMTKLLKKLTRHAPYRASAANDKRHKPEEYL

SEQ ID NO: 9001 - protein, 96 aa, Artificial Sequence
  Computer-generated peptide variant
FWKLLKRWLKWMRKLRAGAKKLLMAYWCFKNLKLYMALKKWKLLEWAKYAIRLAKCWELLEARENEKRRPEKPFMCNGLQLLRRIKNQRTEKRWGP

SEQ ID NO: 9002 - protein, 55 aa, Artificial Sequence
  Computer-generated peptide variant
IMRMFQRMLKRIKKAISFKAREEARALKMLLRRHDARALNAAKILCLRVKNMDRL

SEQ ID NO: 9003 - protein, 35 aa, Artificial Sequence
  Computer-generated peptide variant
KLKFWRKLLKIYRPLYRALNRTPKQPLLGMKLLEC

SEQ ID NO: 9004 - protein, 90 aa, Artificial Sequence
  Computer-generated peptide variant
RLRILRKLFKKFSRWSAWQLRKDKVKACARSYVDLKQLRIKAQLLKSLAQRKRPSLRWLYAWDALLYNLARWLLNYLHGDLDRRNLNGVE

SEQ ID NO: 9005 - protein, 57 aa, Artificial Sequence
  Computer-generated peptide variant
RLKYMSKMLKIIRKPATTMARAAKRRHDTLPEKMKVNGDLLHKLRLHKMLLKLKRAL

SEQ ID NO: 9006 - protein, 29 aa, Artificial Sequence
  Computer-generated peptide variant
RFRWFHKLYRLLKRTAIPRWAKCHQALFA

SEQ ID NO: 9007 - protein, 27 aa, Artificial Sequence
  Computer-generated peptide variant
RLRWLCKWLKKLKTYLLLSLRSYRPLF

SEQ ID NO: 9008 - protein, 53 aa, Artificial Sequence
  Computer-generated peptide variant
KLKYLKKFIRMWRPKIYIKAMKHKASRRLRLNSSTLWIKRLAELANFLRHALC

SEQ ID NO: 9009 - protein, 46 aa, Artificial Sequence
  Computer-generated peptide variant
RIKMWHKFWRLIRREKPRALKDRHARLSFALAARQLRDEFYKKQLA

SEQ ID NO: 9010 - protein, 95 aa, Artificial Sequence
  Computer-generated peptide variant
FMKLLKRLLKRIKKLACAAWIKAWHQLAICPHAVSCRLAALAGYKAVRKKNKRYKLKLALTGAMKVKACGDKRRKLLAGMYRKRRNKDRLFLKND

SEQ ID NO: 9011 - protein, 100 aa, Artificial Sequence
  Computer-generated peptide variant
RYKWYRRMLKYMKHKCKAAKDDKAMKSAPIGAKTKEVELSVFRKLKWLCLYLIRLSKHSLAACRQAAQLRLARKRRPYNALKMRPRPRARKPNAKSGGCF

SEQ ID NO: 9012 - protein, 73 aa, Artificial Sequence
  Computer-generated peptide variant
KYRFLRKLLKFMKRFKCRALFKHAAAALRLTTRLGGMAAMKKQLDNALEHRKFSGRALGAWLNKLDRMRFYDC

SEQ ID NO: 9013 - protein, 22 aa, Artificial Sequence
  Computer-generated peptide variant
ILKIWQRILRRLKKMLQAAPPA

SEQ ID NO: 9014 - protein, 49 aa, Artificial Sequence
  Computer-generated peptide variant
IIKFFRKFLRIFKKRRCQAIAAQRLPAAWLHKAKQLKDRLTMLLRTWDC

SEQ ID NO: 9015 - protein, 20 aa, Artificial Sequence
  Computer-generated peptide variant
RLKLFPRILKKWKRYWLAQF

SEQ ID NO: 9016 - protein, 37 aa, Artificial Sequence
  Computer-generated peptide variant
KWKFLRRIWKKLKQKLLFKLCAFVCNKRKLLLYPLLK

SEQ ID NO: 9017 - protein, 61 aa, Artificial Sequence
  Computer-generated peptide variant
MFRLWSKFFKKWKNRSWARYSRYRRKLGKCKCLMRAERLMRRAPLALERRRNLALKLKTAA

SEQ ID NO: 9018 - protein, 57 aa, Artificial Sequence
  Computer-generated peptide variant
RLKLFRKWLKLIHRHVRRKDALLLRLLANKCVLRKGRRVFKFLPLIMMGRLTITSGD

SEQ ID NO: 9019 - protein, 44 aa, Artificial Sequence
  Computer-generated peptide variant
RLKWLRKLLRLWSPVARNPAHTQKACLLCLTEERLCKWAAREDK

SEQ ID NO: 9020 - protein, 20 aa, Artificial Sequence
  Computer-generated peptide variant
KIRLLPKLLRYLNHRRCQLL

SEQ ID NO: 9021 - protein, 34 aa, Artificial Sequence
  Computer-generated peptide variant
RYRYICKLIKRLPRYAALTGLILKSVMKRPRVLK

SEQ ID NO: 9022 - protein, 60 aa, Artificial Sequence
  Computer-generated peptide variant
KLRYFQRLLKWLCKVERRLGDRAGIRKTPFPIALRMAMPQHVRAAARTLKALHFRLWYRR

SEQ ID NO: 9023 - protein, 68 aa, Artificial Sequence
  Computer-generated peptide variant
KWKWWNKLLRRLHCLRKRLAMAKRQAIKRDPRKMRTLTVDAAGLDLMIQILYDKKRVCRAKEKMNLRV

SEQ ID NO: 9024 - protein, 29 aa, Artificial Sequence
  Computer-generated peptide variant
LFKLLTRLFRKFKKKAKNPVLRRDLLMVQ

SEQ ID NO: 9025 - protein, 69 aa, Artificial Sequence
  Computer-generated peptide variant
LLRLIRKMLKKLKSVWLKIRELRLRQAQAGNRPNKLKFKPNALDVEKAIKGWSAAKLLAAAKHLWGLCT

SEQ ID NO: 9026 - protein, 58 aa, Artificial Sequence
  Computer-generated peptide variant
KMKLLRKWLKFWPRRIAYLAVKCTAGRHWAAGCRRRQQAKRQRFITARWLALAAHRQN

SEQ ID NO: 9027 - protein, 41 aa, Artificial Sequence
  Computer-generated peptide variant
FMKWLPRLMRRLRKKKKGNVALRRKVMGLNEHLKACANLAC

SEQ ID NO: 9028 - protein, 21 aa, Artificial Sequence
  Computer-generated peptide variant
LIKYLRRLYKRFQQQQERLRL

SEQ ID NO: 9029 - protein, 24 aa, Artificial Sequence
  Computer-generated peptide variant
RWRLIKKMMRRLQKLAWHACAANL

SEQ ID NO: 9030 - protein, 45 aa, Artificial Sequence
  Computer-generated peptide variant
YFKLMRRLLRRMCKREERFGSALCWAAFPMHALDRALGQKRRLML

SEQ ID NO: 9031 - protein, 22 aa, Artificial Sequence
  Computer-generated peptide variant
RMRFLKKFIKKLRTKLSLALLA

SEQ ID NO: 9032 - protein, 25 aa, Artificial Sequence
  Computer-generated peptide variant
WMRLLRKLYKLFQRHKAHRPAARPW

SEQ ID NO: 9033 - protein, 46 aa, Artificial Sequence
  Computer-generated peptide variant
KLRWLSRLLRYYSNRMVAFARRALAPLLPTKNLWVIRHALKRPLKC

SEQ ID NO: 9034 - protein, 40 aa, Artificial Sequence
  Computer-generated peptide variant
KLKLLRKFLKLLRKGSFQPGIDWGAEGLRMFASGKARAIA

SEQ ID NO: 9035 - protein, 70 aa, Artificial Sequence
  Computer-generated peptide variant
RIRFFRRLMKRFKRKYANFAALAIKKRTAPKPNRWKRAKICRALCLLCKMTYIARLLLVRLRREALFIHG

SEQ ID NO: 9036 - protein, 52 aa, Artificial Sequence
  Computer-generated peptide variant
RFKWLSKYLKRIQSYLDRKDAKTLQKCAKLLRSLYDKKQAKFKVCAKLIASG

SEQ ID NO: 9037 - protein, 35 aa, Artificial Sequence
  Computer-generated peptide variant
RLKFLKKFWKLLKKNEASKVEKVRTKMRAALHLLE

SEQ ID NO: 9038 - protein, 30 aa, Artificial Sequence
  Computer-generated peptide variant
RMRLFKKFIRYFRNLLKLPLHQRWADLSAA

SEQ ID NO: 9039 - protein, 36 aa, Artificial Sequence
  Computer-generated peptide variant
IIRMLTRIYKRLQHVRSAARARLRRFLAVIAAFADI

SEQ ID NO: 9040 - protein, 20 aa, Artificial Sequence
  Computer-generated peptide variant
YFKLLTRILKRYRKACPTAS

SEQ ID NO: 9041 - protein, 27 aa, Artificial Sequence
  Computer-generated peptide variant
KMKIYTRLFKFLKRARLKAIHAALKIM

SEQ ID NO: 9042 - protein, 33 aa, Artificial Sequence
  Computer-generated peptide variant
LLRIWKKLFRFWRKMVKCAKFNRLRQQFRACLA

SEQ ID NO: 9043 - protein, 86 aa, Artificial Sequence
  Computer-generated peptide variant
LWRLWRRWYKRLTNIANAFWFSLKLAIDRKHAAKRWPILLQAALRLVMKVRKARKGHRRKDKSRSKQAAVLLKRNLVYKPKSSLFK

SEQ ID NO: 9044 - protein, 28 aa, Artificial Sequence
  Computer-generated peptide variant
LYKILKRFFKLLSKLQFKKERWMLRALV

SEQ ID NO: 9045 - protein, 60 aa, Artificial Sequence
  Computer-generated peptide variant
KLRIYKKWLKKLTNCKEVKLLTTIMVARDGVLDAALFKACIDRHKKNGALRKKCCLKLLC

SEQ ID NO: 9046 - protein, 42 aa, Artificial Sequence
  Computer-generated peptide variant
LLKWWKKLFRRIKKKIEVIPANRIARALKICCARGKYLKYSL

SEQ ID NO: 9047 - protein, 26 aa, Artificial Sequence
  Computer-generated peptide variant
KFKLIRKILRFLHRAARFRFLNGAEA

SEQ ID NO: 9048 - protein, 48 aa, Artificial Sequence
  Computer-generated peptide variant
RLRFICRWLRLYKKTWRKLLKRQAEAPALCCSRTHAARRLTKGKKVRA

SEQ ID NO: 9049 - protein, 34 aa, Artificial Sequence
  Computer-generated peptide variant
WFKYYRKLLRKFTRTLLSARRRRDLGVKYANLAK

SEQ ID NO: 9050 - protein, 38 aa, Artificial Sequence
  Computer-generated peptide variant
RFRFLCKLLKRWHSAQVRLDWKIIITAAARARLHKRLP

SEQ ID NO: 9051 - protein, 32 aa, Artificial Sequence
  Computer-generated peptide variant
RLRFFQRYWRKLTRSLCDHHTAEKKLANAKLL

SEQ ID NO: 9052 - protein, 61 aa, Artificial Sequence
  Computer-generated peptide variant
FMRFFHRILKILRRAAKMAAGTLQLRKKSNKEYTLGNAAIELRRRLAADKSLSTTLGLLKK

SEQ ID NO: 9053 - protein, 45 aa, Artificial Sequence
  Computer-generated peptide variant
RLRWLRRFYRFIRRHGRAAMHKACLKRLWARILRLMAAAATARMA

SEQ ID NO: 9054 - protein, 81 aa, Artificial Sequence
  Computer-generated peptide variant
YLRFLQKWMKLLSQQKRPIPVALKMMKFERKAGALSANLLAKRKFKKHAVYKKNKALPPLKHKRRLRALKKAKFTRFWDYL

SEQ ID NO: 9055 - protein, 38 aa, Artificial Sequence
  Computer-generated peptide variant
FFRIFKRFLKLMRRLLLRAPDAAKNYKYWRKLYFTLRW

SEQ ID NO: 9056 - protein, 78 aa, Artificial Sequence
  Computer-generated peptide variant
LLRLYTKYLRLFKRAKLKMADLRYPILEDYNRYRTMWKRALRKGSLDDMFRFTAKALKKQLWNVIVFIARALKRLYSK

SEQ ID NO: 9057 - protein, 22 aa, Artificial Sequence
  Computer-generated peptide variant
MLRLWKKLLRLYRKHNLASRRI

SEQ ID NO: 9058 - protein, 29 aa, Artificial Sequence
  Computer-generated peptide variant
FFKLLRRFLRRLKRILFDKLRWEAAALYA

SEQ ID NO: 9059 - protein, 26 aa, Artificial Sequence
  Computer-generated peptide variant
RLRLYSKLLRLMRQASKDETHGLKLW

SEQ ID NO: 9060 - protein, 43 aa, Artificial Sequence
  Computer-generated peptide variant
WIRWLRKMFKWLKKRRAQVRNDRAKALIMMLRAKVRADAAMNC

SEQ ID NO: 9061 - protein, 21 aa, Artificial Sequence
  Computer-generated peptide variant
KLRFISRLLRRMKTILANQTR

SEQ ID NO: 9062 - protein, 32 aa, Artificial Sequence
  Computer-generated peptide variant
FLRYFRRLLRKLHRTTLTQAACAKHIRPKKVT

SEQ ID NO: 9063 - protein, 24 aa, Artificial Sequence
  Computer-generated peptide variant
YYKLMKKFLRRFCKQANKYAPKLL

SEQ ID NO: 9064 - protein, 31 aa, Artificial Sequence
  Computer-generated peptide variant
LMRLWRRFLKKFSKRLRSRALKTLDRLSHED

SEQ ID NO: 9065 - protein, 34 aa, Artificial Sequence
  Computer-generated peptide variant
RIRLIKRFIRLFRKDCAARAPRLRSILKASLRFG

SEQ ID NO: 9066 - protein, 30 aa, Artificial Sequence
  Computer-generated peptide variant
RLKFIRKILRYLRHAMHLAFGLARMKARII

SEQ ID NO: 9067 - protein, 34 aa, Artificial Sequence
  Computer-generated peptide variant
KMRIWSRIMRKLQRCQDMKKDKAAARLIMLLPAR

SEQ ID NO: 9068 - protein, 30 aa, Artificial Sequence
  Computer-generated peptide variant
WYKLLRRMIRRFTKKAEKAKTQLPLSETKA

SEQ ID NO: 9069 - protein, 46 aa, Artificial Sequence
  Computer-generated peptide variant
KYKFYPRLLRYMRHLRCLNGLLKVDLIAAYKKEPRFDLARSACLAK

SEQ ID NO: 9070 - protein, 43 aa, Artificial Sequence
  Computer-generated peptide variant
RLRMLSKYMRLFTRLQLRRALQRCRAKHQLGGLNPSAGLKKEG

SEQ ID NO: 9071 - protein, 76 aa, Artificial Sequence
  Computer-generated peptide variant
FMRYLQKLFKLICSCDVLARRLVGRKRQRNKVAKSEKAWALAKLIPASHNKLMLAAKDDKKKLHIFEKKSLLCRKL

SEQ ID NO: 9072 - protein, 26 aa, Artificial Sequence
  Computer-generated peptide variant
RWKIICKLFKIWKRKRGQLALLAAQF

SEQ ID NO: 9073 - protein, 32 aa, Artificial Sequence
  Computer-generated peptide variant
RLKILKKFLKKFTRLHASMLKGLGKCTRLGKI

SEQ ID NO: 9074 - protein, 49 aa, Artificial Sequence
  Computer-generated peptide variant
KLKYFKRYLRLISTYGAAAGKKSGKHCLFRKTAKLLLSDLQAKIRYSKC

SEQ ID NO: 9075 - protein, 35 aa, Artificial Sequence
  Computer-generated peptide variant
KFKYLKRYYKLLKTKLLYRQGAWLAKSDLRMHHQL

SEQ ID NO: 9076 - protein, 50 aa, Artificial Sequence
  Computer-generated peptide variant
RLRLWRKLLRLLNPKKHLMPLTYWLQQAHLHLWAYNSMKKHKGKLLRRHD

SEQ ID NO: 9077 - protein, 39 aa, Artificial Sequence
  Computer-generated peptide variant
ILKMWRKILRFLKHALKALDRWAARCKKISKFRGFKANI

SEQ ID NO: 9078 - protein, 96 aa, Artificial Sequence
  Computer-generated peptide variant
RFKMLRKYLRKYRRWLRARRLGGERVKLWAHAKALRNPKMKLKQERNRAVNENAKLKSNAGLEVHSKLLWAINAAKHLQELAKKCEAAGAWKELRA

SEQ ID NO: 9079 - protein, 84 aa, Artificial Sequence
  Computer-generated peptide variant
RLRWWKRMMKRLHQMWRLVAHRFQRTRSAKAKLHADARYLRDKNARKAKADPRKTAQRGELAKVMLQIITALKWLKALQWKSMH

SEQ ID NO: 9080 - protein, 61 aa, Artificial Sequence
  Computer-generated peptide variant
RWKLLKRYLRRFPRAKKELRATVMLGKKTAVKQKLTRRSLGLKAIELRLGQAPRIALKKQS

SEQ ID NO: 9081 - protein, 33 aa, Artificial Sequence
  Computer-generated peptide variant
MLRLIRRYFKRITKKNEMALKKALQRSFLKATA

SEQ ID NO: 9082 - protein, 79 aa, Artificial Sequence
  Computer-generated peptide variant
KWKFLKRILRKIRNLFPRASSKRDNWRGTAQWRLFYAGHKAGKRRVVALATARLRKLEWILRPPRAIRDASGAGLKLRQ

SEQ ID NO: 9083 - protein, 45 aa, Artificial Sequence
  Computer-generated peptide variant
RYKIYKRLLKRFRNCAMKLAGFEAKMVRCFTLKLIAKKAISAAVF

SEQ ID NO: 9084 - protein, 52 aa, Artificial Sequence
  Computer-generated peptide variant
KIRWMPKMYKFYRKALELRAKAPRRFTLAKMIKRILQKISLLLPTKMKSELK

SEQ ID NO: 9085 - protein, 57 aa, Artificial Sequence
  Computer-generated peptide variant
RLKLFPKFIKKLSRRIRLRAAGLNVLKPYLKRLLLLRRTIKALHKNSMQKLKLLRRA

SEQ ID NO: 9086 - protein, 58 aa, Artificial Sequence
  Computer-generated peptide variant
RLRLWKKLMKMLTRDRKATMIRPFKVLKSGKVGANKWDYSLLKERPKLLLINRAIGLA

SEQ ID NO: 9087 - protein, 76 aa, Artificial Sequence
  Computer-generated peptide variant
RLKLMRKLFRLYCRAHWTREFFLLRAHRMVFAAKLFRSDIQFRSHDRRHKRRRLARRALAEAGLDSLRAWVLLPLF

SEQ ID NO: 9088 - protein, 63 aa, Artificial Sequence
  Computer-generated peptide variant
LLKMLRKFLRMLTNLKGGIPAQCTELKRRLRLLDHNRLVAARHRATKAEARKVPGAYLARKGC

SEQ ID NO: 9089 - protein, 47 aa, Artificial Sequence
  Computer-generated peptide variant
KIRLLPKWFRFYCKKEAAANANLAKKEHMLRRTLMWGLYLTRRKKQL

SEQ ID NO: 9090 - protein, 45 aa, Artificial Sequence
  Computer-generated peptide variant
KLRMWQKWLKLLPKLPARLKKAKKEPMKTAAMEQPAHYKVCLDRP

SEQ ID NO: 9091 - protein, 39 aa, Artificial Sequence
  Computer-generated peptide variant
RLKLLKRFLRYYTKCACHRLAELLLWKKIMRKASMKGRG

SEQ ID NO: 9092 - protein, 40 aa, Artificial Sequence
  Computer-generated peptide variant
RYKWFRRLLKKFQKAWAANKYEFIKLALARRCGHLKFTAW

SEQ ID NO: 9093 - protein, 28 aa, Artificial Sequence
  Computer-generated peptide variant
KIKMLKKLLKLLQKTCEPLKDRALGKFC

SEQ ID NO: 9094 - protein, 38 aa, Artificial Sequence
  Computer-generated peptide variant
LFKYLRKYYRLFKRRLTACRVLTWPRALKCQKELDWKD

SEQ ID NO: 9095 - protein, 64 aa, Artificial Sequence
  Computer-generated peptide variant
LIRYWRRLWKLLKKLLLKLKHPRDKQYKLSLLTKQRHKFLWCGCMRSKYDARRRCHFDAAKKAN

SEQ ID NO: 9096 - protein, 23 aa, Artificial Sequence
  Computer-generated peptide variant
KYRLLHKMYRRWKRFAFCLTKAA

SEQ ID NO: 9097 - protein, 40 aa, Artificial Sequence
  Computer-generated peptide variant
KIRLLQRLFRWFKKRHWAILKAKSAFSAKLSFRWRQCYSL

SEQ ID NO: 9098 - protein, 30 aa, Artificial Sequence
  Computer-generated peptide variant
LYKLLKRFLRFYCKLVNHAQALAGLVRRFR

SEQ ID NO: 9099 - protein, 38 aa, Artificial Sequence
  Computer-generated peptide variant
KLRFFKKLFRMIRKRNMKAPELVKCHAQRKAAGAMCLE

SEQ ID NO: 9100 - protein, 43 aa, Artificial Sequence
  Computer-generated peptide variant
KFRLFKRLLRKWRRVWLRHNCLAAVKRSKILPFLLQERCNYCR

SEQ ID NO: 9101 - protein, 35 aa, Artificial Sequence
  Computer-generated peptide variant
MLKWFPKWLRKLHRNRAEATAKQQAIHGELAKLLR

SEQ ID NO: 9102 - protein, 27 aa, Artificial Sequence
  Computer-generated peptide variant
RFRLLRKWFRFWRTLIAAKAAQKAMEG

SEQ ID NO: 9103 - protein, 40 aa, Artificial Sequence
  Computer-generated peptide variant
RYKFYRRLLRKFKQWQAYKLLALRTKAFNKRPASDVSWAL

SEQ ID NO: 9104 - protein, 42 aa, Artificial Sequence
  Computer-generated peptide variant
YLKILHRLFRMIKHKRKRLNKKLFKLRRPQILLRMAAYKWLL

SEQ ID NO: 9105 - protein, 22 aa, Artificial Sequence
  Computer-generated peptide variant
LFRLFQRWFRKLRSLCAKKAHD

SEQ ID NO: 9106 - protein, 62 aa, Artificial Sequence
  Computer-generated peptide variant
KYKILRRIYKKLKSADLGRVKKHSLFRDLQQRLQAKPRQRVAWPHLLRSKIAHFARRARNFA

SEQ ID NO: 9107 - protein, 61 aa, Artificial Sequence
  Computer-generated peptide variant
FLKLLRRLFKKLKTAIAPRRDLAACRDLKEEWRRASVRVWKQMRTQYLLQKRHRKAGQMLT

SEQ ID NO: 9108 - protein, 64 aa, Artificial Sequence
  Computer-generated peptide variant
RYRMLNRFIRLLQRLDVAFKRLPLPTLSLAELSKKTIYQKKRLRALKLARKAFDYKEGAFSMNL

SEQ ID NO: 9109 - protein, 75 aa, Artificial Sequence
  Computer-generated peptide variant
KLKLLKKFIRRLRKPDERDLQAANNLQFLIPRAKFSGRLFAQQKALRGYALRMAARAPNQPKKRLRRKALAKWIN

SEQ ID NO: 9110 - protein, 67 aa, Artificial Sequence
  Computer-generated peptide variant
FYRLLRKLYRKFCRAKAKYQIVISERRRLLKYRMRMRRPALWTRHWHKLLQNPRALTAYAKYAAGAA

SEQ ID NO: 9111 - protein, 34 aa, Artificial Sequence
  Computer-generated peptide variant
KFRWLKRFFKKMRRLQLGQSNLRARIYLFDARAN

SEQ ID NO: 9112 - protein, 44 aa, Artificial Sequence
  Computer-generated peptide variant
LLRLLKRMIKLWQSRGWHAHRMGAKTQLMRANKARRYLAAEKQM

SEQ ID NO: 9113 - protein, 29 aa, Artificial Sequence
  Computer-generated peptide variant
KFRFLNRIIKLLCKGFKHCLRRILRFLAT

SEQ ID NO: 9114 - protein, 61 aa, Artificial Sequence
  Computer-generated peptide variant
MLKLLRKLLRWLRSHAAPHRYPNQRKRLLWLCFKGVMFAEVKYKRSMKLLHLHKAKNYWAR

SEQ ID NO: 9115 - protein, 20 aa, Artificial Sequence
  Computer-generated peptide variant
FFKYLQRLIRLFKRYAYQLA

SEQ ID NO: 9116 - protein, 73 aa, Artificial Sequence
  Computer-generated peptide variant
RLRLMKRILRRYKQKMLRACANQLAGAMSAAAALAKGADEQLKRKRLARKWASVICFQLAKKVDMINKHLLKD

SEQ ID NO: 9117 - protein, 20 aa, Artificial Sequence
  Computer-generated peptide variant
KLKIFRKLLRLLHCVWGQFA

SEQ ID NO: 9118 - protein, 34 aa, Artificial Sequence
  Computer-generated peptide variant
KYRFIKRMLRRFRKIAAECDALNNLRLRVQKLLE

SEQ ID NO: 9119 - protein, 64 aa, Artificial Sequence
  Computer-generated peptide variant
KMRFFRKMFKIMKKAKPWYWLLKAKAAKDKNARMAIAKRLACLMNEARDECAWDTKRVKATPLA

SEQ ID NO: 9120 - protein, 44 aa, Artificial Sequence
  Computer-generated peptide variant
KLRLFRKMMKKLHRYAETLAARKMLLLKRPLRLKVENLRDAWAY

SEQ ID NO: 9121 - protein, 85 aa, Artificial Sequence
  Computer-generated peptide variant
KLKIFRRFLKRWKCLVLMLAWKQLLKLRKAMNLHLRGKDQDAVFANHDCSKAARIRKPAHQWSLSKRALAAIPMLKACRNQSARS

SEQ ID NO: 9122 - protein, 27 aa, Artificial Sequence
  Computer-generated peptide variant
YFRLFHRWYKLLKRISGLARKMAGPRA

SEQ ID NO: 9123 - protein, 28 aa, Artificial Sequence
  Computer-generated peptide variant
RLKLMKKLIRRMNQNALRRRIWFAWQAE

SEQ ID NO: 9124 - protein, 47 aa, Artificial Sequence
  Computer-generated peptide variant
LLRMLKKLLKWFRQQMAKKLCLRFKAHPKLRRLRIWYLYIVMMLLTP

SEQ ID NO: 9125 - protein, 22 aa, Artificial Sequence
  Computer-generated peptide variant
LMRWFRRLLRILRTNFPDAKAA

SEQ ID NO: 9126 - protein, 21 aa, Artificial Sequence
  Computer-generated peptide variant
LMKFLRRFIRFLNRARLERCS

SEQ ID NO: 9127 - protein, 33 aa, Artificial Sequence
  Computer-generated peptide variant
RFRFWKRIWKLLHHKLLKYNYPLKKLPLARRLK

SEQ ID NO: 9128 - protein, 95 aa, Artificial Sequence
  Computer-generated peptide variant
RWKFYKRMWKMIRKLKQCCWLKYMFRAAARCRRIKARMKPLNQLRRARAQLKQLHAAHQRFAKLLMAHLPAMARYAAAKLKRAGRIYKWWNTPKL

SEQ ID NO: 9129 - protein, 42 aa, Artificial Sequence
  Computer-generated peptide variant
KYRFLRRLIKMWCRVKWDLRAIAKMGYYQLKLMRAKSAARVK

SEQ ID NO: 9130 - protein, 30 aa, Artificial Sequence
  Computer-generated peptide variant
LLRMMRKFIRRWSKTLAKEHKQRAKSMAQA

SEQ ID NO: 9131 - protein, 36 aa, Artificial Sequence
  Computer-generated peptide variant
KWRFLKKWIKRFSSKLERLITLSLARDAMQQARKLP

SEQ ID NO: 9132 - protein, 53 aa, Artificial Sequence
  Computer-generated peptide variant
KMKLFRRLLRLYPSANYPGWHRALLAWMCKGAMLWKWRKASKLAKREADAGRD

SEQ ID NO: 9133 - protein, 28 aa, Artificial Sequence
  Computer-generated peptide variant
YWKMIKKWLRLLKNAAWATRLEKLVLYK

SEQ ID NO: 9134 - protein, 33 aa, Artificial Sequence
  Computer-generated peptide variant
LYKWLRRLLRRLKPHRPKWALDKTKLMGALRPG

SEQ ID NO: 9135 - protein, 25 aa, Artificial Sequence
  Computer-generated peptide variant
RFKLMSKLYRKIRHIRALAMHKIWA

SEQ ID NO: 9136 - protein, 34 aa, Artificial Sequence
  Computer-generated peptide variant
WYRLIKRLMRKFRKDNRKTLLSYLRAHCYSLMAK

SEQ ID NO: 9137 - protein, 45 aa, Artificial Sequence
  Computer-generated peptide variant
KLKFWRRFFRKLQPMLIYLRAALILECKILTRKPQLLRGQADARH

SEQ ID NO: 9138 - protein, 24 aa, Artificial Sequence
  Computer-generated peptide variant
LFKLFKRYMKRWSRAQWLEAKLAV

SEQ ID NO: 9139 - protein, 71 aa, Artificial Sequence
  Computer-generated peptide variant
KLKMISRLWRKWQKAAPKVRSANLDLYTAVRCCAKLKRPYLHAKHLRLRAPAIFKDTDLARTTVMAKKLRH

SEQ ID NO: 9140 - protein, 29 aa, Artificial Sequence
  Computer-generated peptide variant
KLRLLNRFFKLMNPSLMRNLRLCILFRDR

SEQ ID NO: 9141 - protein, 50 aa, Artificial Sequence
  Computer-generated peptide variant
FLKMLKRYWKKLRRRARRNLVVEPARIRKHRERNGKALRFILLDAFREAL

SEQ ID NO: 9142 - protein, 56 aa, Artificial Sequence
  Computer-generated peptide variant
RMRMLSRFFRKIKQEAPAKLLFLHKLLNAEVAKALKRHMVFFRIFLDLHRLGIRLK

SEQ ID NO: 9143 - protein, 85 aa, Artificial Sequence
  Computer-generated peptide variant
WLKFLKKWYKRWRPRLARHHLALQARLLEHNRLRLARKLEKKKRVNCLLIKSLKLLLNARLSFVLEGKIRWLYRKSDYWAKCVLL

SEQ ID NO: 9144 - protein, 20 aa, Artificial Sequence
  Computer-generated peptide variant
LLKLFNKYLRKYRKDTFLAA

SEQ ID NO: 9145 - protein, 61 aa, Artificial Sequence
  Computer-generated peptide variant
KIKLLKRYFKYMKQAAPLRRADRKKKQWLKHNILKAFALALHTAKSLYKEQCAGHGKVCKL

SEQ ID NO: 9146 - protein, 27 aa, Artificial Sequence
  Computer-generated peptide variant
LFKYIRRLYRMLTQRLDVATLKAKKHT

SEQ ID NO: 9147 - protein, 34 aa, Artificial Sequence
  Computer-generated peptide variant
KWRLFRKLFKKLNKMRNVIRVAAARCIEAEWLKG

SEQ ID NO: 9148 - protein, 47 aa, Artificial Sequence
  Computer-generated peptide variant
FWRFLRRLFKRWCTAPAIIKRMAARAASQAGVHAVKKRRPVAKYLIL

SEQ ID NO: 9149 - protein, 54 aa, Artificial Sequence
  Computer-generated peptide variant
KYKIYTKYMKKFPQRRKLSLLALYLNRAIALLKIDRKSSTLGRRAERRSLLAIL

SEQ ID NO: 9150 - protein, 74 aa, Artificial Sequence
  Computer-generated peptide variant
RLRLLKRLLKRYSSKLRFEMPPLLLWHDYKAAASGRMLWLVWAWARSKSWLQRGMYKFEEFLKKYLALQLRLVL

SEQ ID NO: 9151 - protein, 24 aa, Artificial Sequence
  Computer-generated peptide variant
RFKILNKLMKKIKSISAAARKTPL

SEQ ID NO: 9152 - protein, 47 aa, Artificial Sequence
  Computer-generated peptide variant
RIRFFTKFLRIWRRKLTLGLCAHRYKQARLTLLAKALLLWTLTWYGS

SEQ ID NO: 9153 - protein, 58 aa, Artificial Sequence
  Computer-generated peptide variant
RLRWMRKMLRFYCKLLEKYAQNTLIHAIQKALLKRRASPKLLAKNSLTVAENATTKRF

SEQ ID NO: 9154 - protein, 90 aa, Artificial Sequence
  Computer-generated peptide variant
RLKIFKKFYRLFSKCLKVRELKCKLNANLEKSDRAAAFKIRCPKPADIYYWDNALLRSITKRAAERMWLLWTLKKYCKQHLALLACLARL

SEQ ID NO: 9155 - protein, 34 aa, Artificial Sequence
  Computer-generated peptide variant
KMKFLHRLFKKLPKYRMRKFPQPAQLSRAAFEKA

SEQ ID NO: 9156 - protein, 32 aa, Artificial Sequence
  Computer-generated peptide variant
FLKLFCRYLKFWKSARRRRALVKAANHYRRAA

SEQ ID NO: 9157 - protein, 45 aa, Artificial Sequence
  Computer-generated peptide variant
MLRLYPKLWKKFCKDLESAKCMLRPHKKKAPLALKFRGKNPRYAN

SEQ ID NO: 9158 - protein, 29 aa, Artificial Sequence
  Computer-generated peptide variant
RLKLLRKIFKKLPNAAIRIKTMTCALRGC

SEQ ID NO: 9159 - protein, 37 aa, Artificial Sequence
  Computer-generated peptide variant
YFRMLRRIFKWYSKRLCRYTAMKDIAMLALKKRLLGL

SEQ ID NO: 9160 - protein, 25 aa, Artificial Sequence
  Computer-generated peptide variant
MYKLLRRWLRLLTRLAKAVSCRNLK

SEQ ID NO: 9161 - protein, 61 aa, Artificial Sequence
  Computer-generated peptide variant
RIRMLNRLLKRLHKDQQKKLLAWELMTYRGAQALARAMRLRQGKKPRLMKFHKFRAFMKDK

SEQ ID NO: 9162 - protein, 40 aa, Artificial Sequence
  Computer-generated peptide variant
KLRMFKKWLRILKSDKRRPIATTECCAIAAELVRKPLKML

SEQ ID NO: 9163 - protein, 70 aa, Artificial Sequence
  Computer-generated peptide variant
RLRYFRKFMRKLRQHVLLSALFRKRPPTKEARALLMAKRKGLGLKKFKLQHRLKRRELAKECNFITVNIS

SEQ ID NO: 9164 - protein, 36 aa, Artificial Sequence
  Computer-generated peptide variant
IMKLYHKILKKLKKWAVRNRYDQAWLKSPLRLEQLL

SEQ ID NO: 9165 - protein, 35 aa, Artificial Sequence
  Computer-generated peptide variant
YLRYITKLLKKIRCVLAALRKIAAPAYLVRAQQRK

SEQ ID NO: 9166 - protein, 36 aa, Artificial Sequence
  Computer-generated peptide variant
KFKWWPKLYKLLKKDKTRYAWRGLAHCVVCAEARLA

SEQ ID NO: 9167 - protein, 34 aa, Artificial Sequence
  Computer-generated peptide variant
WFKFLRRFLRLFRRQATCHRPNRKAKMNLLARHN

SEQ ID NO: 9168 - protein, 39 aa, Artificial Sequence
  Computer-generated peptide variant
KLRIMQRIFRFMKKLLGKLLELLAGLRATKWRQNKLGLW

SEQ ID NO: 9169 - protein, 27 aa, Artificial Sequence
  Computer-generated peptide variant
FLRLIKRYFRKFSKLAAWNMAKRVKAC

SEQ ID NO: 9170 - protein, 33 aa, Artificial Sequence
  Computer-generated peptide variant
RFRLMCRLFKLLKQRLSRASNLRLKKWKLKPLF

SEQ ID NO: 9171 - protein, 22 aa, Artificial Sequence
  Computer-generated peptide variant
KYKLLRRIYRLINKKSPRGLLA

SEQ ID NO: 9172 - protein, 35 aa, Artificial Sequence
  Computer-generated peptide variant
LFRLWKKLLRKITHVAVKKAPLHIQAALRALPRRY

SEQ ID NO: 9173 - protein, 48 aa, Artificial Sequence
  Computer-generated peptide variant
LYRWLRRMFRLFNSCWRKKTVYLKPCRLRCAKKDLMATMPTKAKALAA

SEQ ID NO: 9174 - protein, 21 aa, Artificial Sequence
  Computer-generated peptide variant
MFRLWRKFIKFLCKCRAKLAQ

SEQ ID NO: 9175 - protein, 42 aa, Artificial Sequence
  Computer-generated peptide variant
FLRLFRRLLRLFKPAERRTAIETMGAKPKKRNSFLAAKWCLK

SEQ ID NO: 9176 - protein, 41 aa, Artificial Sequence
  Computer-generated peptide variant
KLRLLPRWFKRFQKVCIARFPKMWRIMHLLLSLVLARAKEK

SEQ ID NO: 9177 - protein, 48 aa, Artificial Sequence
  Computer-generated peptide variant
MLRFFPKFFKRFRKRDALRAFIKSAPRGRDLATAKYDHRRYKLLFMAL

SEQ ID NO: 9178 - protein, 22 aa, Artificial Sequence
  Computer-generated peptide variant
MLKYMKRLWKIYKKDALKGIAL

SEQ ID NO: 9179 - protein, 83 aa, Artificial Sequence
  Computer-generated peptide variant
RMKFWNRWLRKMSRVMLKAAAARRELFKQMQKDVLLKWKKMEHLKKLFKQAKMKDESYASARKYKRFWAVKMAKPDRAFALLL

SEQ ID NO: 9180 - protein, 40 aa, Artificial Sequence
  Computer-generated peptide variant
KIKLLTRLLRKINSARGARLWYIREMSGAAKQKFLCKKRA

SEQ ID NO: 9181 - protein, 28 aa, Artificial Sequence
  Computer-generated peptide variant
RLKMIRKLMKKYRNLLAPAILCFRRKCA

SEQ ID NO: 9182 - protein, 60 aa, Artificial Sequence
  Computer-generated peptide variant
LFKLLSKYLRMLRHCYKLRQPWSRMKMAEKLDNKDAPMYLHLLFRLPLNRAKRLKRRKIY

SEQ ID NO: 9183 - protein, 40 aa, Artificial Sequence
  Computer-generated peptide variant
ILRYLKKWLKIWTHKADLRRAKLWYLVRRHHARWIALSRQ

SEQ ID NO: 9184 - protein, 25 aa, Artificial Sequence
  Computer-generated peptide variant
WLRYFRRLLKWFRKLANAYADSKFK

SEQ ID NO: 9185 - protein, 22 aa, Artificial Sequence
  Computer-generated peptide variant
KFKLLNKLYKLLPRWILFAKFR

SEQ ID NO: 9186 - protein, 92 aa, Artificial Sequence
  Computer-generated peptide variant
MMRYLTRLFKKWPKKLTKRKKMEVSRILLWRAARSKKKLSLLAWLRIPHAEDKDRLASCRMWKLELLRKAWEAVALTRVRKTRRQAVYLKCK

SEQ ID NO: 9187 - protein, 30 aa, Artificial Sequence
  Computer-generated peptide variant
LFKLMQRLWKRFRKWQKLYEAAKVSLKNRA

SEQ ID NO: 9188 - protein, 28 aa, Artificial Sequence
  Computer-generated peptide variant
KLRLMRRIWRRLKHMVPCSLALDYLMAR

SEQ ID NO: 9189 - protein, 76 aa, Artificial Sequence
  Computer-generated peptide variant
RLKFFRKLIKLLQKLKKHHVKLEMAPYRKLKSSFFFKAEFREARAAKKEGRAKRSGGKANVTLNNFGRVALKAKQV

SEQ ID NO: 9190 - protein, 25 aa, Artificial Sequence
  Computer-generated peptide variant
KMRLLPKYLRLWCRCDTFKRQAARY

SEQ ID NO: 9191 - protein, 60 aa, Artificial Sequence
  Computer-generated peptide variant
LIRLIPRYFRKWRHERHFKELRLNKLRRFTLRRVFLLLILSDRYAAMLRKLCAKSRPKVW

SEQ ID NO: 9192 - protein, 39 aa, Artificial Sequence
  Computer-generated peptide variant
RLRLYNKLIKLIRHHRRCYLCTLLVKIRAQKSEKALRLR

SEQ ID NO: 9193 - protein, 23 aa, Artificial Sequence
  Computer-generated peptide variant
LLKLMKRWFKRFKKVAAQCEAWR

SEQ ID NO: 9194 - protein, 38 aa, Artificial Sequence
  Computer-generated peptide variant
IYRWLKRYFRRFRNLLKQRWPLAMPAHAAHKCAKLSKG

SEQ ID NO: 9195 - protein, 29 aa, Artificial Sequence
  Computer-generated peptide variant
FLRWIKRLLRFLPNRRLKAIARAYLLRHK

SEQ ID NO: 9196 - protein, 21 aa, Artificial Sequence
  Computer-generated peptide variant
KMKFYSKLLKKFKHILAAARM

SEQ ID NO: 9197 - protein, 34 aa, Artificial Sequence
  Computer-generated peptide variant
LMRLLTKLLKILKRHGDLEDILNKTAHMIRRFLR

SEQ ID NO: 9198 - protein, 35 aa, Artificial Sequence
  Computer-generated peptide variant
MFKLMKRFWRYLKCKARRTDLRLLAKPCTADKHLY

SEQ ID NO: 9199 - protein, 74 aa, Artificial Sequence
  Computer-generated peptide variant
YLKMIRKLIKMWKKIVMKLELLIKFKELLTARNLLLALCEREQLLLRLRKRGFLKDKVPRRHHRRQAILLQKRF

SEQ ID NO: 9200 - protein, 27 aa, Artificial Sequence
  Computer-generated peptide variant
LWKYLQRYLKKLRKQAMQAIRKRWLNQ

SEQ ID NO: 9201 - protein, 23 aa, Artificial Sequence
  Computer-generated peptide variant
KFRYFQRLLRRLHSGRAGWLLAE

SEQ ID NO: 9202 - protein, 61 aa, Artificial Sequence
  Computer-generated peptide variant
RFRFYNKFLRKLKRNKCKLAATKKAEVSYGKIRLLKELFEARVHKAELSMFKALAAARDIK

SEQ ID NO: 9203 - protein, 31 aa, Artificial Sequence
  Computer-generated peptide variant
LFRIYKRMWKIYRPNLLRLILARKLKKHLAA

SEQ ID NO: 9204 - protein, 43 aa, Artificial Sequence
  Computer-generated peptide variant
RFKLLRRIWKRIRQKAAYGDKEARKAKKAALWHATDEPNARCL

SEQ ID NO: 9205 - protein, 43 aa, Artificial Sequence
  Computer-generated peptide variant
RFKLLKRWIKILRCGAKADAQGRPLCEPAQRPRSLGACRLAKF

SEQ ID NO: 9206 - protein, 36 aa, Artificial Sequence
  Computer-generated peptide variant
LMKMLRRMLRWFRNARAYQHTLLRNGLFLQKSPLKK

SEQ ID NO: 9207 - protein, 43 aa, Artificial Sequence
  Computer-generated peptide variant
KMKLLKRLLRFLRQASKKALRPRVAKMCSFGAQKKAKNRDPHG

SEQ ID NO: 9208 - protein, 41 aa, Artificial Sequence
  Computer-generated peptide variant
RLRILPRMLKRYRKSTKAPAKAPMRLFRLRSHCALAAMKRD

SEQ ID NO: 9209 - protein, 42 aa, Artificial Sequence
  Computer-generated peptide variant
RYKIFKKMMRKYCSLKLALAPQAEKMLKRKARLRVAAYVPWR

SEQ ID NO: 9210 - protein, 23 aa, Artificial Sequence
  Computer-generated peptide variant
IWRYIRKLYRKLTTALARKLMLP

SEQ ID NO: 9211 - protein, 55 aa, Artificial Sequence
  Computer-generated peptide variant
KWKLWRRIIKFFKKKLFRKAVLCKRAKAADKLRGLMYHCASKLVFALVVRAYFKA

SEQ ID NO: 9212 - protein, 24 aa, Artificial Sequence
  Computer-generated peptide variant
RIKMLPRMLKKWRKHLSLRWAHLM

SEQ ID NO: 9213 - protein, 76 aa, Artificial Sequence
  Computer-generated peptide variant
RLKMLKKWLKLLRTKSKSYLLPNKWEMLPRHSAFTLKTAKLRNGCRKLARWVRYHLYLLAAPALIGIAKEKFSLKC

SEQ ID NO: 9214 - protein, 77 aa, Artificial Sequence
  Computer-generated peptide variant
RLKYLRRLIRRWRRLRDFARARRRQLRKHALKNFCTAWWARLKRTRNAARNGILLEPLLFSKPDAKYSPQVEHWDCA

SEQ ID NO: 9215 - protein, 24 aa, Artificial Sequence
  Computer-generated peptide variant
KLRLLNKLLRKFKSLKDEQQVLTF

SEQ ID NO: 9216 - protein, 22 aa, Artificial Sequence
  Computer-generated peptide variant
RLRLYRRMLRYYQKGEKLLAHA

SEQ ID NO: 9217 - protein, 35 aa, Artificial Sequence
  Computer-generated peptide variant
KLRLLQRLLKRWTKERRKYAQRARVTAWEFRTLCA

SEQ ID NO: 9218 - protein, 34 aa, Artificial Sequence
  Computer-generated peptide variant
RLKLMKKFLRLFSTALVDSRFLKALHRAGNHKAA

SEQ ID NO: 9219 - protein, 84 aa, Artificial Sequence
  Computer-generated peptide variant
RLRFINRLFRKFTRAAAAKIAKLWGDLNFCHHNGCRFVARKKGLKRGWLKKKAYLNKRCEAKLRKRGLRILKQTELRLLLACMA

SEQ ID NO: 9220 - protein, 38 aa, Artificial Sequence
  Computer-generated peptide variant
RYRFMNRFLKKFQKRAMWLLKAKRIWAHHVRLTLWLEA

SEQ ID NO: 9221 - protein, 55 aa, Artificial Sequence
  Computer-generated peptide variant
FLRLWRRLLRWMRCYARKTKLRLQDPMASQKKLGAAKLNHARALWKMKKRTQCKE

SEQ ID NO: 9222 - protein, 78 aa, Artificial Sequence
  Computer-generated peptide variant
LLKFIKKLWRRLNNKIRRRNTMQWKSALLKSERASADFLWTLRLYIQCVMLKRRRKNAKIKQYCIRRMAALRLYLATS

SEQ ID NO: 9223 - protein, 67 aa, Artificial Sequence
  Computer-generated peptide variant
LMRFYRRLFKRIKKLLLRLKRRKARALVKYFWESNCNFLEAAPDKLYNFKYKFTWGAKKCRLFYKAS

SEQ ID NO: 9224 - protein, 44 aa, Artificial Sequence
  Computer-generated peptide variant
KLRLFTRILKRFKKHWKCCPLYLDLRPSSGLAAKSLLPALKKQL

SEQ ID NO: 9225 - protein, 20 aa, Artificial Sequence
  Computer-generated peptide variant
RFRLLCKLIRKWPNLSWQRL

SEQ ID NO: 9226 - protein, 25 aa, Artificial Sequence
  Computer-generated peptide variant
MLRLFKKYLRKWKSRAIFIKRAVAA

SEQ ID NO: 9227 - protein, 50 aa, Artificial Sequence
  Computer-generated peptide variant
RFKFWSKILKLFRPRMLRLLKGKRKAYLAAPKPKDRAYLGARRLQKAMLY

SEQ ID NO: 9228 - protein, 31 aa, Artificial Sequence
  Computer-generated peptide variant
RWKFIKKWYRKLRKKAANAFRRTSNCALAAL

SEQ ID NO: 9229 - protein, 67 aa, Artificial Sequence
  Computer-generated peptide variant
FIRFLKRLWKRMKKHLELTLGALASALAKLERRYANDFTQKKHARAKLDREHAKPACIKLCMTRWLN

SEQ ID NO: 9230 - protein, 49 aa, Artificial Sequence
  Computer-generated peptide variant
RIKILPRFLKRWCKLPRSPKKFGYAGAALADARPEALQADAEKGRLLRA

SEQ ID NO: 9231 - protein, 34 aa, Artificial Sequence
  Computer-generated peptide variant
KFKFLRKFIKLFRTRGLRGGLKFFRFANARLTIL

SEQ ID NO: 9232 - protein, 55 aa, Artificial Sequence
  Computer-generated peptide variant
LWRLLRRILKRWKKVKLLASKGHARLMRWKMLIACFNALLYLQRCMHRLCWYKLV

SEQ ID NO: 9233 - protein, 51 aa, Artificial Sequence
  Computer-generated peptide variant
MYRLMPRLFKKMKRRYSGKKKAQLMAKLRLANKYLKENRTILILHYAKVLE

SEQ ID NO: 9234 - protein, 34 aa, Artificial Sequence
  Computer-generated peptide variant
WYKFWRRLLRKLRKTAANRCAEAPAKMQFWQALH

SEQ ID NO: 9235 - protein, 71 aa, Artificial Sequence
  Computer-generated peptide variant
FIKFIKRFLKKMSKRLLMKLRAKKLEARALRALLPKRIRKRMNPLGLCKCWTDSKIARQCKPVKVLTKHAM

SEQ ID NO: 9236 - protein, 47 aa, Artificial Sequence
  Computer-generated peptide variant
RFRLLPRWLRRIRRPLWNAERTIARTRAAFLDACKFRKVNNLLAKEM

SEQ ID NO: 9237 - protein, 67 aa, Artificial Sequence
  Computer-generated peptide variant
LYKYFPKWLKRLRPLLAVEFKLHGLLSLRKADMVWKRLRECERSAKKACDGRAPQRGAHRLLYYKKW

SEQ ID NO: 9238 - protein, 62 aa, Artificial Sequence
  Computer-generated peptide variant
RMKMFQKFLKKFKQALLLPLAFNIRLEQEYLLYAPGGKLIKPVKLKLPIASKKKRRAFRKHL

SEQ ID NO: 9239 - protein, 49 aa, Artificial Sequence
  Computer-generated peptide variant
LLRLLKKFWKKMRKKLPMLKRDARACALVKDEAVARSMGMKPSQLGAAL

SEQ ID NO: 9240 - protein, 33 aa, Artificial Sequence
  Computer-generated peptide variant
FFKFLRRFLKFFKKLKCYLKLAKMKDRVAHELF

SEQ ID NO: 9241 - protein, 56 aa, Artificial Sequence
  Computer-generated peptide variant
WMRWFRRLYRWYRCSSAKGAKLKLKCLPKNKLEHKRRDALCKGKARDRAKMAFALL

SEQ ID NO: 9242 - protein, 46 aa, Artificial Sequence
  Computer-generated peptide variant
KLKMIRKIWRRLRKSKKGYLNALLNMALDYCPAPAAKRVYIRQRSR

SEQ ID NO: 9243 - protein, 38 aa, Artificial Sequence
  Computer-generated peptide variant
LYKFLSRLFKKMCRLLARPKDMKKVRSVLGLLPWHRVA

SEQ ID NO: 9244 - protein, 72 aa, Artificial Sequence
  Computer-generated peptide variant
RLKFFRKLLKRWRRRFVKEIYLLARWRNGAAKEYQYLLLALRRWRAFILCGLAAKTWKMDRRVWKPQIGLRT

SEQ ID NO: 9245 - protein, 25 aa, Artificial Sequence
  Computer-generated peptide variant
KIRLLKKLLRYIKKAGAEFRGFMHC

SEQ ID NO: 9246 - protein, 33 aa, Artificial Sequence
  Computer-generated peptide variant
ILRLFKRLYKLFTTRQLKLKTDLMWKFAKLKSW

SEQ ID NO: 9247 - protein, 37 aa, Artificial Sequence
  Computer-generated peptide variant
FLRMLNKILKYYKRADPLRSFWEKDKAKKMCAHRLLR

SEQ ID NO: 9248 - protein, 65 aa, Artificial Sequence
  Computer-generated peptide variant
KIKFWRKFLRWLRRSRMAARWFRSANLLRPKKAYKWVARCLAHRFLAWFSDQLFAYRAAKEADYG

SEQ ID NO: 9249 - protein, 25 aa, Artificial Sequence
  Computer-generated peptide variant
KLKMYNKLFKKLKHLALAYANDVRR

SEQ ID NO: 9250 - protein, 26 aa, Artificial Sequence
  Computer-generated peptide variant
FFKLLTRLIRIWTTARALLCRNRARL

SEQ ID NO: 9251 - protein, 87 aa, Artificial Sequence
  Computer-generated peptide variant
RLKLLRRYLKIFRKALPIKLKVRRCHAKLSNQKRNSKYPTNEDKRPRRKTQHLGAAKRYVAPRSEATTFSCLRGTLVARAKATAAIR

SEQ ID NO: 9252 - protein, 22 aa, Artificial Sequence
  Computer-generated peptide variant
KLRILHRLIKYFTRKAHYLADK

SEQ ID NO: 9253 - protein, 64 aa, Artificial Sequence
  Computer-generated peptide variant
RLRLLNKWWRRWPNAFRWELVLAERLKADKVKHFCALRVGVWNKLKATAVWKKWRRDPRAKIRR

SEQ ID NO: 9254 - protein, 84 aa, Artificial Sequence
  Computer-generated peptide variant
RMRIMRRIYRRYKSHCWKCSALFRAAAMWARMALRLWQHASRRLLSRALAKKALCRKKLRLRQKIRQPARIKKIPDLYWYQMMR

SEQ ID NO: 9255 - protein, 25 aa, Artificial Sequence
  Computer-generated peptide variant
RMRYYNKLFKKYPKYALEMALRDKL

SEQ ID NO: 9256 - protein, 39 aa, Artificial Sequence
  Computer-generated peptide variant
KLRFFRKLFKLIRKAEKNVQCLGSARLMWALALMYKMNK

SEQ ID NO: 9257 - protein, 41 aa, Artificial Sequence
  Computer-generated peptide variant
RMKLWKRLLRRYSRRGTLRAHNMLNNLLNQAVARARLMRRH

SEQ ID NO: 9258 - protein, 24 aa, Artificial Sequence
  Computer-generated peptide variant
KLRYWCKLMKKLSCPRLKLKAYML

SEQ ID NO: 9259 - protein, 62 aa, Artificial Sequence
  Computer-generated peptide variant
KLRFMRRWWRRWCCERALKWRRERKVAILRRAFAIRAPLKRHKWRQSALPLRELLLRLKFLT

SEQ ID NO: 9260 - protein, 24 aa, Artificial Sequence
  Computer-generated peptide variant
RMKMWCKYFRLLRCCLYAKSALRR

SEQ ID NO: 9261 - protein, 38 aa, Artificial Sequence
  Computer-generated peptide variant
RMKLICRFFRKWKNLLAKKACCGRKLRYALMHSILAWI

SEQ ID NO: 9262 - protein, 24 aa, Artificial Sequence
  Computer-generated peptide variant
LLRLLPKFMKKLKQMMNWAWRKEL

SEQ ID NO: 9263 - protein, 22 aa, Artificial Sequence
  Computer-generated peptide variant
KLRLLHKFYKKLKRFKKILLLN

SEQ ID NO: 9264 - protein, 80 aa, Artificial Sequence
  Computer-generated peptide variant
LLRLIKRFLRRLQRKARAAEHGLQDAAKQIKYPARLRRIRPKAQKRFIIYHKEYKLREADDKWYAFKMRLHRTAMKEHAL

SEQ ID NO: 9265 - protein, 47 aa, Artificial Sequence
  Computer-generated peptide variant
KFKWWKKLIKKMSPAKETMAQLNQRYLWDRARAARAYAFKKRGCLGA

SEQ ID NO: 9266 - protein, 31 aa, Artificial Sequence
  Computer-generated peptide variant
LIKLIKRFIKFLRKKQALKKHLFVALRQYYD

SEQ ID NO: 9267 - protein, 33 aa, Artificial Sequence
  Computer-generated peptide variant
KLKLLKRILKRYRSRLKFSLKRCRAAGWQLFFT

SEQ ID NO: 9268 - protein, 20 aa, Artificial Sequence
  Computer-generated peptide variant
KLRFYQRLIRLIHRALITRY

SEQ ID NO: 9269 - protein, 45 aa, Artificial Sequence
  Computer-generated peptide variant
RYRIFNRLLRLWKTALKAANCDNEARKVYRCLLWWRRLQRAQLEW

SEQ ID NO: 9270 - protein, 23 aa, Artificial Sequence
  Computer-generated peptide variant
KLKLFRKFYKKFSHAAAKRAGQD

SEQ ID NO: 9271 - protein, 59 aa, Artificial Sequence
  Computer-generated peptide variant
FLRFLRKLMKRLKRAEHWCLLALRARARLLGARKDFPRRIKCSKVASALRYRHPVTKCD

SEQ ID NO: 9272 - protein, 60 aa, Artificial Sequence
  Computer-generated peptide variant
KIRMYCRFLKLWRPKDCWRAKRYNLWKLLARAATAKTTAAAANDKAMMKRKRLKAPQKWN

SEQ ID NO: 9273 - protein, 23 aa, Artificial Sequence
  Computer-generated peptide variant
RIRWLKRFLRYFTKCAKALIADR

SEQ ID NO: 9274 - protein, 65 aa, Artificial Sequence
  Computer-generated peptide variant
RYKLWKRLFKFFNKWFWYLTLYPACIKKKRKLALVLLCKRRQGSDMAASAFLLTRHAAAYAFALQ

SEQ ID NO: 9275 - protein, 27 aa, Artificial Sequence
  Computer-generated peptide variant
KFRLLKKMMRLIQNLPLKAKTVVNKKL

SEQ ID NO: 9276 - protein, 36 aa, Artificial Sequence
  Computer-generated peptide variant
LFRFIPKLFRRFKSRWSCIFLARRRDALKMTALLKR

SEQ ID NO: 9277 - protein, 29 aa, Artificial Sequence
  Computer-generated peptide variant
MLRLIRRLLRILKKYRIYYRAEFENRAYT

SEQ ID NO: 9278 - protein, 20 aa, Artificial Sequence
  Computer-generated peptide variant
RFKMFSRLFRRLRSMLLPSA

SEQ ID NO: 9279 - protein, 44 aa, Artificial Sequence
  Computer-generated peptide variant
FFRMWPRLFKRLRRKDKPALLAKRLEWNRRACKLGATAKPLTCN

SEQ ID NO: 9280 - protein, 88 aa, Artificial Sequence
  Computer-generated peptide variant
RFKYLQRLIKYLTRLLRCASDARRAAKKVAKYGSADKLRQERIRRGALKLAGKAVRCTAHLDVVIKRTPLHKAKMKHSERNAWKNPRC

SEQ ID NO: 9281 - protein, 35 aa, Artificial Sequence
  Computer-generated peptide variant
WLRWLQKFLRRYRKALKCRARGAAIPQAYTKAPWC

SEQ ID NO: 9282 - protein, 39 aa, Artificial Sequence
  Computer-generated peptide variant
RLKMLCRYIKLWSKLREHHARPAADRKMKPLLHFRAKLL

SEQ ID NO: 9283 - protein, 21 aa, Artificial Sequence
  Computer-generated peptide variant
YLKIITKLIKRMTKRYALLPL

SEQ ID NO: 9284 - protein, 77 aa, Artificial Sequence
  Computer-generated peptide variant
LIRLMTKFWRLFKCRANRRIIPGRADWKTRALAQRYCRLWRVAAANAWACACLWKSGKVNRAKLLARFVRCSPAKLR

SEQ ID NO: 9285 - protein, 32 aa, Artificial Sequence
  Computer-generated peptide variant
KFKLFRRMMRRWNKRRALALMALLSACAKEQY

SEQ ID NO: 9286 - protein, 86 aa, Artificial Sequence
  Computer-generated peptide variant
KWRLMKRLMRWFKNPAHTAARMKKDRVSLAIYLAFCRELWMMRAALGLQAACIAIQEVDLARHTLKARLPRKRTRLGGLAAIKIAK

SEQ ID NO: 9287 - protein, 28 aa, Artificial Sequence
  Computer-generated peptide variant
RMRFLCKMYRRFKRLWWETLLAAAHAEK

SEQ ID NO: 9288 - protein, 77 aa, Artificial Sequence
  Computer-generated peptide variant
RLRFIPRMLKKYQKHRYKKLECAFLAWAHDLWKEERIFARNQELTLAKVSLKRAAKRIQCRKRLVWFAKRTHRMAKK

SEQ ID NO: 9289 - protein, 39 aa, Artificial Sequence
  Computer-generated peptide variant
IMRLLKRFLKRLRRSASPCWKYVMLPFQALWADALRRSR

SEQ ID NO: 9290 - protein, 25 aa, Artificial Sequence
  Computer-generated peptide variant
KIKLLRRYLRRWPTYNQLAGILARK

SEQ ID NO: 9291 - protein, 20 aa, Artificial Sequence
  Computer-generated peptide variant
RIKWLPRLIKKLKKMIAQHA

SEQ ID NO: 9292 - protein, 61 aa, Artificial Sequence
  Computer-generated peptide variant
RFKFLRKFLRLYKRWQKAHQEMKRQADDHTYKAARVSTLLKLLVCLLRARADAKNHKVVIR

SEQ ID NO: 9293 - protein, 24 aa, Artificial Sequence
  Computer-generated peptide variant
RLRLWCKMLKKFHSALLWFNAKDK

SEQ ID NO: 9294 - protein, 30 aa, Artificial Sequence
  Computer-generated peptide variant
ILRWWRKFYKLMRCDAFKLKTLLKIGAMLK

SEQ ID NO: 9295 - protein, 30 aa, Artificial Sequence
  Computer-generated peptide variant
RFKLWPRLMRLLRKDGARFDLIQCLIRRFA

SEQ ID NO: 9296 - protein, 40 aa, Artificial Sequence
  Computer-generated peptide variant
WYRLIPKLYKKYNCAKKAKLILYSLELAAKIRRLVAKWAI

SEQ ID NO: 9297 - protein, 32 aa, Artificial Sequence
  Computer-generated peptide variant
RLKIFSKYFRKMKQSAAKLLSRPALWRAKAAF

SEQ ID NO: 9298 - protein, 58 aa, Artificial Sequence
  Computer-generated peptide variant
LMRYIHKYMKRFKQKTQKKATVCAEARLKALPKQWRACMHLKPQKLLLVVLLARRALT

SEQ ID NO: 9299 - protein, 68 aa, Artificial Sequence
  Computer-generated peptide variant
LMRFIQKLLRRLRKYAAAWVDKAIDLKLLVGKHYKLRKYYLIQRSGKMLQLRWKQPMAFALARFWNLA

SEQ ID NO: 9300 - protein, 88 aa, Artificial Sequence
  Computer-generated peptide variant
KLRIFQRFFRLWKTRVKSNLIIAKINLLKKALRFLLKKAQRAWAHVLALHLRDKWLEHGKLRIAAFKALNLFNLQQKAHERDLTLTAW

SEQ ID NO: 9301 - protein, 59 aa, Artificial Sequence
  Computer-generated peptide variant
FLKFMCKLIKKLRTLAWVKKRVWKFYKLKSPLHRHLRAERNWLALKGALAPKKRALKAY

SEQ ID NO: 9302 - protein, 40 aa, Artificial Sequence
  Computer-generated peptide variant
KYRMIKRYLRWFSKYALARPELWQKLYAHLQAYHLAKRKL

SEQ ID NO: 9303 - protein, 57 aa, Artificial Sequence
  Computer-generated peptide variant
RFRFFKKMIKKFKCGFRALQRGQILTLKLSKRPLARKALDALYHKSALMNAKALEEA

SEQ ID NO: 9304 - protein, 98 aa, Artificial Sequence
  Computer-generated peptide variant
KFKLFPKLYKKMKSLHLQRARLRVARMQAKQSRKRKKWRWKNLRYRVIVLWDVRAIKTRAKRMHKKLLATDAKFRDLVMEALYRWAELFAAWAWPLAT

SEQ ID NO: 9305 - protein, 24 aa, Artificial Sequence
  Computer-generated peptide variant
RLKFLKRFMRMLRRAQQARLKMVA

SEQ ID NO: 9306 - protein, 30 aa, Artificial Sequence
  Computer-generated peptide variant
RFRFLSKWLRLIRCQVPLTLLTAKKYLALM

SEQ ID NO: 9307 - protein, 48 aa, Artificial Sequence
  Computer-generated peptide variant
IWRYLHRLLKFLRTRQRRAFPALKDKLLWKAEALRSKEAKMWLRIMSI

SEQ ID NO: 9308 - protein, 37 aa, Artificial Sequence
  Computer-generated peptide variant
WFKLFRKFYRKLKKRGQASWFLNRQLKDYLLAPRKFL

SEQ ID NO: 9309 - protein, 30 aa, Artificial Sequence
  Computer-generated peptide variant
YLRFITRLIKKLNKSALRINEDLKRRRMLT

SEQ ID NO: 9310 - protein, 37 aa, Artificial Sequence
  Computer-generated peptide variant
LFRILCRMLRKLPRIKKKCYAHLKLEEAALHESQAFL

SEQ ID NO: 9311 - protein, 31 aa, Artificial Sequence
  Computer-generated peptide variant
MLKYWKRWIKLLPKTALRLSLKAAAQKWLRA

SEQ ID NO: 9312 - protein, 41 aa, Artificial Sequence
  Computer-generated peptide variant
RLKIIRKLIKIWKRKGRACLAHRMGNARAKKPLLPKDKSAL

SEQ ID NO: 9313 - protein, 99 aa, Artificial Sequence
  Computer-generated peptide variant
KLKLLCKMYRMFRHKLLLRALEDLEACCDTKLWKAHERLLQHRKKRRPFYKYAKRAPMLMFKLRNQRFLSDRKRLDVKQALLKRKYLAHPQEQKCIWRQ

SEQ ID NO: 9314 - protein, 69 aa, Artificial Sequence
  Computer-generated peptide variant
KMKWFCRLIRRLRHVGKRHLLKKLQLKRLHFYGCDRFGLKWYKKKAAVAYMGRKRTGLHTTLLEYRLKL

SEQ ID NO: 9315 - protein, 38 aa, Artificial Sequence
  Computer-generated peptide variant
KYRLFTKFWKKLPKRACDYALATYYRAALLYQLLRCKC

SEQ ID NO: 9316 - protein, 96 aa, Artificial Sequence
  Computer-generated peptide variant
LLRLLTRWLRRFPNRYAYRTKHKIYQVIIRLSRKSKRKTIRLVYCDKEMWATDLKLKASRKSALRHPAGRALRAWLAEAALCCRRGRRVLMAAWAD

SEQ ID NO: 9317 - protein, 57 aa, Artificial Sequence
  Computer-generated peptide variant
RIRLFKKLFRILRRRGMADLADEAAKNLRFARALHMAAFKTTKAQVVHSFAASQKNA

SEQ ID NO: 9318 - protein, 69 aa, Artificial Sequence
  Computer-generated peptide variant
FLKWLKRFWRRFRPALWRDKWRNNHFFHAIQQNKAAKLAKAAKCYILHEKARKKCLKPEMGATKLLAAY

SEQ ID NO: 9319 - protein, 37 aa, Artificial Sequence
  Computer-generated peptide variant
RLKFFNKLLKLWKNDILIARRKHKMMAKMSKVLFALT

SEQ ID NO: 9320 - protein, 57 aa, Artificial Sequence
  Computer-generated peptide variant
RMKIFQRFFRRLHRILLHRARIAKGLWIELHLRAAAHLRCIIAQQAMRATRKKFARK

SEQ ID NO: 9321 - protein, 26 aa, Artificial Sequence
  Computer-generated peptide variant
IMKYMTRFLRLLKRLFDPKVLLARSA

SEQ ID NO: 9322 - protein, 75 aa, Artificial Sequence
  Computer-generated peptide variant
RLRWWTRLLRKFRKMHRIRFRRRLKIDLWQHYTLLLFADKLTVYDKRGANAALEMAKGWVLAKGLMLALRRLHDN

SEQ ID NO: 9323 - protein, 58 aa, Artificial Sequence
  Computer-generated peptide variant
KMRWLTRFLKRMHRLKGGDKPHRASLARCVLRARKLVKKMLAKGKLFASKLRWSLWDK

SEQ ID NO: 9324 - protein, 40 aa, Artificial Sequence
  Computer-generated peptide variant
KFRWLRRMMRLIHRQVLYKRLAPMMATDIYRLRLKAQKQR

SEQ ID NO: 9325 - protein, 23 aa, Artificial Sequence
  Computer-generated peptide variant
YLKLFRKFWRRLQCKLGLALGRR

SEQ ID NO: 9326 - protein, 27 aa, Artificial Sequence
  Computer-generated peptide variant
YLKIFPKLLRRMPRARMKTMRAMDCLL

SEQ ID NO: 9327 - protein, 40 aa, Artificial Sequence
  Computer-generated peptide variant
LLRIFKRIIRIIQKKLEEHKGAGLLAFRKVARWIKMKKVL

SEQ ID NO: 9328 - protein, 25 aa, Artificial Sequence
  Computer-generated peptide variant
RLKYIRRLLRIYKKATLQASLCLRM

SEQ ID NO: 9329 - protein, 29 aa, Artificial Sequence
  Computer-generated peptide variant
KLRLLRKLLKYWRPKITFGLHATKGAKAA

SEQ ID NO: 9330 - protein, 55 aa, Artificial Sequence
  Computer-generated peptide variant
KYKLMKRMWKLWTTARIVSRGLRRGLNWKRLKLIRKNKRELEALERLAWFVGNAL

SEQ ID NO: 9331 - protein, 28 aa, Artificial Sequence
  Computer-generated peptide variant
RLRLFKKLLKYICRLNDKPRYNAEAANK

SEQ ID NO: 9332 - protein, 30 aa, Artificial Sequence
  Computer-generated peptide variant
MLKFMKRLYKRLRRDAKKERVLLSLLILAF

SEQ ID NO: 9333 - protein, 29 aa, Artificial Sequence
  Computer-generated peptide variant
RFRWLKRLWKRMCSLKGAMLDPKEAAILQ

SEQ ID NO: 9334 - protein, 58 aa, Artificial Sequence
  Computer-generated peptide variant
RIRILNKLLKKLRQVMHMALKKARCDSKALLRQKAKVVPGAYAMACPVTKNRIANARL

SEQ ID NO: 9335 - protein, 42 aa, Artificial Sequence
  Computer-generated peptide variant
KLKLLKKLYKIYHKRGQGLKYAASLKILKRLGLHASACKEFL

SEQ ID NO: 9336 - protein, 29 aa, Artificial Sequence
  Computer-generated peptide variant
KIRLMSKFLRKMRCLDRLGMARACAWKQV

SEQ ID NO: 9337 - protein, 20 aa, Artificial Sequence
  Computer-generated peptide variant
IMRLLRKFLKRFTHEKNAWA

SEQ ID NO: 9338 - protein, 21 aa, Artificial Sequence
  Computer-generated peptide variant
RLRFLTKLLKKICCLMMNAKN

SEQ ID NO: 9339 - protein, 39 aa, Artificial Sequence
  Computer-generated peptide variant
RMKWFRRWLRRFNKTTIAKSATKSLAAQKLQEANKALAH

SEQ ID NO: 9340 - protein, 43 aa, Artificial Sequence
  Computer-generated peptide variant
KMRLFHKFLRKWKTILLVTSIALSIKFDKAAAAAGHFRRDAAR

SEQ ID NO: 9341 - protein, 20 aa, Artificial Sequence
  Computer-generated peptide variant
LYRYLKKFLRRLRRQVAGMA

SEQ ID NO: 9342 - protein, 28 aa, Artificial Sequence
  Computer-generated peptide variant
RLRIIKRLYKRLQKRLFIKYAKLLDQLW

SEQ ID NO: 9343 - protein, 43 aa, Artificial Sequence
  Computer-generated peptide variant
RFKYFSKFLKLLQPRNWLVTAIKHPRKKRARRCARDLTAALRM

SEQ ID NO: 9344 - protein, 21 aa, Artificial Sequence
  Computer-generated peptide variant
FLKLLHKLIKKMRHAAEVLLR

SEQ ID NO: 9345 - protein, 42 aa, Artificial Sequence
  Computer-generated peptide variant
LLRIMRKLYRRYSCCKKARLTGKPKPQGLLKRLTALARAQYR

SEQ ID NO: 9346 - protein, 47 aa, Artificial Sequence
  Computer-generated peptide variant
YFRLIRRMFKRWTHMQSSLKAAKLLQKKKLGNTARAKTKWLFAPFLK

SEQ ID NO: 9347 - protein, 24 aa, Artificial Sequence
  Computer-generated peptide variant
LIKLLKRWIKLIRRRLAAKRMSLA

SEQ ID NO: 9348 - protein, 47 aa, Artificial Sequence
  Computer-generated peptide variant
LYKMFCRWLRWLNRPTIKLRILAQCKRRRLRRQNLMCQHHAKNLKRL

SEQ ID NO: 9349 - protein, 58 aa, Artificial Sequence
  Computer-generated peptide variant
KLKYLRRFLKYMTSAAGRRHIWGKRLCADCRSRQKVKSWCFLNAKNMAKAAALKGAKH

SEQ ID NO: 9350 - protein, 21 aa, Artificial Sequence
  Computer-generated peptide variant
FLKLLPRFYRKLRKKLARPVW

SEQ ID NO: 9351 - protein, 41 aa, Artificial Sequence
  Computer-generated peptide variant
KFKLYHKWLRKLKTKKKPAKGLLRQKLSRMNYMKATQLAEC

SEQ ID NO: 9352 - protein, 20 aa, Artificial Sequence
  Computer-generated peptide variant
LMKLMRRWLKRLKNAKLKAS

SEQ ID NO: 9353 - protein, 83 aa, Artificial Sequence
  Computer-generated peptide variant
LIKMYQRFLKKIPHKLKRAFYAAWTRKFRCAYMIAAQRYAALDRHLPPKRELPRKCKTRKKRRRENTLKRCRLYYLGEKGALW

SEQ ID NO: 9354 - protein, 43 aa, Artificial Sequence
  Computer-generated peptide variant
KMKLMNKLLKKFSKNQRVSLHIVKTRKLLLKSLLGRKNQRLAI

SEQ ID NO: 9355 - protein, 28 aa, Artificial Sequence
  Computer-generated peptide variant
MIKFLKRLWRKFKREKLAQLQAVASASK

SEQ ID NO: 9356 - protein, 27 aa, Artificial Sequence
  Computer-generated peptide variant
RIKLLKRMYRLWRTLTEKMMQNRLGAA

SEQ ID NO: 9357 - protein, 49 aa, Artificial Sequence
  Computer-generated peptide variant
RWRYFTKFLKKYRRLAKADDSHGRYLARGLRREAAQQASNKRIALKSRF

SEQ ID NO: 9358 - protein, 34 aa, Artificial Sequence
  Computer-generated peptide variant
KIRIWKRWYRLYRTCASKGCRWAAATAGRLAALE

SEQ ID NO: 9359 - protein, 34 aa, Artificial Sequence
  Computer-generated peptide variant
RFKLLKRLIKKFCQARPKAQWANEDLKHALVDMA

SEQ ID NO: 9360 - protein, 48 aa, Artificial Sequence
  Computer-generated peptide variant
WWKYYKRLLRRLSKFIKVAEQLKLQEKKRWRLHTKLLMLLIIKRASLH

SEQ ID NO: 9361 - protein, 22 aa, Artificial Sequence
  Computer-generated peptide variant
RFRFMPKLIKWLKKAKLTSQLL

SEQ ID NO: 9362 - protein, 31 aa, Artificial Sequence
  Computer-generated peptide variant
KYKFLKRLWKKLRKSKPALALHKANLGSKHE

SEQ ID NO: 9363 - protein, 32 aa, Artificial Sequence
  Computer-generated peptide variant
RLKLLRRYYKKLHSYLFKKAKTAKQADLRETR

SEQ ID NO: 9364 - protein, 45 aa, Artificial Sequence
  Computer-generated peptide variant
KLKLLCRWLRYLRCARRKLFPKLRAMPIAKPNRKFSHNIRLVKAS

SEQ ID NO: 9365 - protein, 90 aa, Artificial Sequence
  Computer-generated peptide variant
LFRLLKRFLRRIKRFRRRMVLVAALAQADAKRAIKPWRRNIRRVIRFDAKAPAANWFTTDMLPLTKRWAEYVRAAECSYRARATLRLQGK

SEQ ID NO: 9366 - protein, 30 aa, Artificial Sequence
  Computer-generated peptide variant
MLRFMCKLFRMLRTVRRALQKFARRALCAG

SEQ ID NO: 9367 - protein, 20 aa, Artificial Sequence
  Computer-generated peptide variant
LYRWFKKLWKFLKPLLGLDK

SEQ ID NO: 9368 - protein, 34 aa, Artificial Sequence
  Computer-generated peptide variant
ILKLYKRLIKKICKAMRDLLTKAQRQSMAKYATL

SEQ ID NO: 9369 - protein, 85 aa, Artificial Sequence
  Computer-generated peptide variant
RLRYLCRFLKRFRKDVCMKELYKYFREKKLRACINQRAKLLALARLDQLFRDDHIASFHNREALLRPLKYRFKRLLTMYAQLALA

SEQ ID NO: 9370 - protein, 43 aa, Artificial Sequence
  Computer-generated peptide variant
YWRLLKRYYKKLCRLKLALSNKIYDLAFAKAAIAKSKGRWAVE

SEQ ID NO: 9371 - protein, 23 aa, Artificial Sequence
  Computer-generated peptide variant
FWRMMNKLYKKLRRLLDHHRAKA

SEQ ID NO: 9372 - protein, 49 aa, Artificial Sequence
  Computer-generated peptide variant
RMKFLRKFWRYIKRLALTKLKLAMQRERLKWWAQEFEKVAHKRFTLVAM

SEQ ID NO: 9373 - protein, 93 aa, Artificial Sequence
  Computer-generated peptide variant
RLRWFSRMLKRYKKCWALAKRHRFTNKYQRAKHLLIPLTARYLRKKAHYKPTALKARRLQSDRLQQLLMRRAKAASHLFRKYFNGFLMALNWL

SEQ ID NO: 9374 - protein, 43 aa, Artificial Sequence
  Computer-generated peptide variant
LLRIWNRLYKKLRRRRTAAKMRLAYAMQGCHPDRLKGADPYLA

SEQ ID NO: 9375 - protein, 30 aa, Artificial Sequence
  Computer-generated peptide variant
RFKLYPRWLRKLNRVRRQTGARQLLACCPA

SEQ ID NO: 9376 - protein, 51 aa, Artificial Sequence
  Computer-generated peptide variant
RLKLLPRFLKRLKKKWALIQKGAALPWIGLWAATMRDTKELQLMVLRQKTD

SEQ ID NO: 9377 - protein, 33 aa, Artificial Sequence
  Computer-generated peptide variant
RFKLIKKLYKMWKRKFLKALLFRHNLYAAVTAR

SEQ ID NO: 9378 - protein, 21 aa, Artificial Sequence
  Computer-generated peptide variant
RLRYFPKYLKRYRRAAGALKL

SEQ ID NO: 9379 - protein, 38 aa, Artificial Sequence
  Computer-generated peptide variant
KLKLLCRMLKRFRRAQQKRALLVAWKKAIKKLAVSWDQ

SEQ ID NO: 9380 - protein, 52 aa, Artificial Sequence
  Computer-generated peptide variant
RFKLFSRWFRRMQSARSKAFKRLLAAERELNFAARTARRRAAKRHYLYVVCV

SEQ ID NO: 9381 - protein, 43 aa, Artificial Sequence
  Computer-generated peptide variant
LMRMLPRLYKRLKREKAHKQRYYKSICAIRLPRKVLLKKALMM

SEQ ID NO: 9382 - protein, 76 aa, Artificial Sequence
  Computer-generated peptide variant
RYKLWRKLLRFLRRILLHAKWCTQMLRLLAGPNVAAGASRKARAARTKRAGKYTWVQTLVLRNAATRVRWARMSKK

SEQ ID NO: 9383 - protein, 20 aa, Artificial Sequence
  Computer-generated peptide variant
RLKLFRKFFKYLPRIKSLAM

SEQ ID NO: 9384 - protein, 28 aa, Artificial Sequence
  Computer-generated peptide variant
FYRLYRKLWKLFKREAHATSAYYSAALK

SEQ ID NO: 9385 - protein, 38 aa, Artificial Sequence
  Computer-generated peptide variant
IMKLLHRYFKRMRKICPLSALIYLEVRAWAGRLLCKRK

SEQ ID NO: 9386 - protein, 52 aa, Artificial Sequence
  Computer-generated peptide variant
KLRLFHRLFRRIRKRDAASAINLWHCKEKLKAHKILYCLRKYKESPAKAFDT

SEQ ID NO: 9387 - protein, 64 aa, Artificial Sequence
  Computer-generated peptide variant
KWKYFPRLLKKLKKKNRNRNSVCRAAYLLKIAACKAQYLAWRAAFGVRKDMYYTRAMIELALKK

SEQ ID NO: 9388 - protein, 43 aa, Artificial Sequence
  Computer-generated peptide variant
RIKFFTRMLRFLKKLLTAYRSALKARRLLRYQRYALSKQPLFW

SEQ ID NO: 9389 - protein, 44 aa, Artificial Sequence
  Computer-generated peptide variant
KYRLFKKFLRKWCRWKMDKSLLKPTAYSAATFFAKAAILNRSKA

SEQ ID NO: 9390 - protein, 60 aa, Artificial Sequence
  Computer-generated peptide variant
RLKLLNRLMKKLHCLARLSSSNKNLAETGEKAHFLRRQKTMFAMALRNASKEFVRAAKVA

SEQ ID NO: 9391 - protein, 58 aa, Artificial Sequence
  Computer-generated peptide variant
KFRYYKRYYRLWHPRKLKLAAENIAGDMAKAQEFLLALRQALNRLSKTAKKQNPALCY

SEQ ID NO: 9392 - protein, 30 aa, Artificial Sequence
  Computer-generated peptide variant
KFKLIRRLWKLMKNFRSARAANKARFKYLL

SEQ ID NO: 9393 - protein, 57 aa, Artificial Sequence
  Computer-generated peptide variant
KWKYFPKMIKLFRRKLPKLLKVDAKTATSFLLRGLRAKAWLPLKGVWLFLEFLLEKW

SEQ ID NO: 9394 - protein, 34 aa, Artificial Sequence
  Computer-generated peptide variant
RLKWFKKLFKRLRRMLWIELRCLYLARTVGKCSL

SEQ ID NO: 9395 - protein, 54 aa, Artificial Sequence
  Computer-generated peptide variant
IFKLFCKLFRLMRKPGRLRLGPKNLLDLVLAQARKRKKDCARILQCVSAMAKAH

SEQ ID NO: 9396 - protein, 50 aa, Artificial Sequence
  Computer-generated peptide variant
LYKLFRKIFRRLNCPRRRRGALELVYITKYAYGIAKALKKNKEAAAETRM

SEQ ID NO: 9397 - protein, 46 aa, Artificial Sequence
  Computer-generated peptide variant
RLKFWKKFWKRFRKLIARLRHRAGLCCTLHFVAAKWRKMTADGAAH

SEQ ID NO: 9398 - protein, 39 aa, Artificial Sequence
  Computer-generated peptide variant
KWKFWKKFYKMFKKACLSAKMRLACKKLSGKAEFHARAA

SEQ ID NO: 9399 - protein, 23 aa, Artificial Sequence
  Computer-generated peptide variant
RFKWMRRFFRLLPKQPAHYALKA

SEQ ID NO: 9400 - protein, 28 aa, Artificial Sequence
  Computer-generated peptide variant
RLKLWNRYIRRLRKWSLTVALSAHAHDL

SEQ ID NO: 9401 - protein, 38 aa, Artificial Sequence
  Computer-generated peptide variant
RLRYLPRFLKIFQNWAKKLRRVEQARCLSAAALAFVLK

SEQ ID NO: 9402 - protein, 38 aa, Artificial Sequence
  Computer-generated peptide variant
KLKWIKKFFRFYRQWFKVYALRKLKWLPLGLEKRDADL

SEQ ID NO: 9403 - protein, 42 aa, Artificial Sequence
  Computer-generated peptide variant
RWKYFNRFWKYLKCLAAKCRPAQKRAKRQDLAARKWVKMPLA

SEQ ID NO: 9404 - protein, 53 aa, Artificial Sequence
  Computer-generated peptide variant
RFKILKRWIKLLKKPQKGAARKLLRNALNCVAAARCRDLEASKRDPHRIGVCR

SEQ ID NO: 9405 - protein, 48 aa, Artificial Sequence
  Computer-generated peptide variant
MMKWLKKFIRRFRKAKKILRQLFFMFAFRPALPERQMLLAKLWLNIKL

SEQ ID NO: 9406 - protein, 61 aa, Artificial Sequence
  Computer-generated peptide variant
RFRMYQRLFRLYRQKAMAACYKLRKLAWTCADVLCLKAQVAWKKRRYCCLTLKHHRSKKYA

SEQ ID NO: 9407 - protein, 49 aa, Artificial Sequence
  Computer-generated peptide variant
RMRILRRFWKFLKPLRLSADGWLFKDKNRLLMNFRGTLLARQRSKYAAG

SEQ ID NO: 9408 - protein, 76 aa, Artificial Sequence
  Computer-generated peptide variant
IMRLYRRMLKYLNNAWKWYYKRKWAAQIAMNACRGWAFKLMVALRQWLLRRLKKDRKRRLARDKEMKENHKLQRKE

SEQ ID NO: 9409 - protein, 28 aa, Artificial Sequence
  Computer-generated peptide variant
LWKFYKRLLKKMCCNLRGRRASVNADKL

SEQ ID NO: 9410 - protein, 64 aa, Artificial Sequence
  Computer-generated peptide variant
FLKILPRLLRFMRNRRRAMRILALKHWRTKNAKGERAAQVAYSMRKKPGPKYKLYSCWAAARAA

SEQ ID NO: 9411 - protein, 39 aa, Artificial Sequence
  Computer-generated peptide variant
RFKFLKKMFKFLRRKALKALINLYLKRAVMKIHAQKACS

SEQ ID NO: 9412 - protein, 37 aa, Artificial Sequence
  Computer-generated peptide variant
WWRLFKKLYRRLSNYKLWARRCRKLYAAAFPLRNARL

SEQ ID NO: 9413 - protein, 21 aa, Artificial Sequence
  Computer-generated peptide variant
LMRIMPKFLRLIQKKQALLDA

SEQ ID NO: 9414 - protein, 37 aa, Artificial Sequence
  Computer-generated peptide variant
WYKLLQRYFKIMKQKGARKLLKKMLIARDFAARPDRI

SEQ ID NO: 9415 - protein, 40 aa, Artificial Sequence
  Computer-generated peptide variant
RWKYWQKMIRRFHKQAKAKKYLSLDLYTKLVLLQLASKRR

SEQ ID NO: 9416 - protein, 40 aa, Artificial Sequence
  Computer-generated peptide variant
FLRWFQRYLKLIKKRHSKLKRTCKQWWYARMAEAARLRMG

SEQ ID NO: 9417 - protein, 35 aa, Artificial Sequence
  Computer-generated peptide variant
KFKYLSRFLKLMHKHDKELLRLSYVYKWLAMLRAR

SEQ ID NO: 9418 - protein, 41 aa, Artificial Sequence
  Computer-generated peptide variant
RFRLLSKLWRRFRKAKEFQAAKKEALRHKLFLTALKLKSKH

SEQ ID NO: 9419 - protein, 33 aa, Artificial Sequence
  Computer-generated peptide variant
FLRMFRKLIRLYRRRRAAALKLFLNDCRVSSKE

SEQ ID NO: 9420 - protein, 32 aa, Artificial Sequence
  Computer-generated peptide variant
LMKMLRRMLKKLNKAMLKCRLPWFLYRAPKQR

SEQ ID NO: 9421 - protein, 22 aa, Artificial Sequence
  Computer-generated peptide variant
LLKMMCRLLKKINTRLTIAMLR

SEQ ID NO: 9422 - protein, 37 aa, Artificial Sequence
  Computer-generated peptide variant
MLKIYRKWWRKLQTKARALRKAKCLYLTDATPRLPDK

SEQ ID NO: 9423 - protein, 26 aa, Artificial Sequence
  Computer-generated peptide variant
KLKLISKLLRKLRRLQCAKQDKLAFP

SEQ ID NO: 9424 - protein, 49 aa, Artificial Sequence
  Computer-generated peptide variant
YFRFFHRLLKKYPKASRDKAFAFACLWAAKRLRLPGRNAKRCCHRAPYG

SEQ ID NO: 9425 - protein, 62 aa, Artificial Sequence
  Computer-generated peptide variant
KYKFYRRMLRRLRRFVARDAHTRAKRAFAKAQDLLRWCARQRHAAQEAYKAREMKRLKMCLL

SEQ ID NO: 9426 - protein, 42 aa, Artificial Sequence
  Computer-generated peptide variant
KFRLLHKYLKRWTKRLLGRLQASYKWPAPRCRRILLRQNWLA

SEQ ID NO: 9427 - protein, 28 aa, Artificial Sequence
  Computer-generated peptide variant
RWRYLQRLWKMWTKMRLSIKLKSLLKVA

SEQ ID NO: 9428 - protein, 30 aa, Artificial Sequence
  Computer-generated peptide variant
FMKMLRKLFRRLPKKADYIMKISRLLLWAR

SEQ ID NO: 9429 - protein, 24 aa, Artificial Sequence
  Computer-generated peptide variant
RLRIMRRIFKWMKKKATLHMAILA

SEQ ID NO: 9430 - protein, 23 aa, Artificial Sequence
  Computer-generated peptide variant
LLRFLRKFFKRYRTNAKAMLMAL

SEQ ID NO: 9431 - protein, 69 aa, Artificial Sequence
  Computer-generated peptide variant
KMRLLKRLLRILQKGLLNCARAFRKIIGTRLALHAYGDKCVDRKKVLKMKLLALPLCELSILRQPLWWR

SEQ ID NO: 9432 - protein, 70 aa, Artificial Sequence
  Computer-generated peptide variant
MIKILKRLMKLLKNCVRKALLAQEAKMMITHSNFCRAAWLRRLHLRYAKLRRNKVPALARAFCWHIMRPR

SEQ ID NO: 9433 - protein, 23 aa, Artificial Sequence
  Computer-generated peptide variant
ILKLLPRWIRLFRCQQRIHKARA

SEQ ID NO: 9434 - protein, 20 aa, Artificial Sequence
  Computer-generated peptide variant
WFKFLKRLYRLLSCLKQMRR

SEQ ID NO: 9435 - protein, 20 aa, Artificial Sequence
  Computer-generated peptide variant
RWKMISRMLKRLRKLEACLP

SEQ ID NO: 9436 - protein, 27 aa, Artificial Sequence
  Computer-generated peptide variant
KMRFLPKLIKKMSRKNLAALLNDVRTY

SEQ ID NO: 9437 - protein, 22 aa, Artificial Sequence
  Computer-generated peptide variant
LYRFLCKWLKLYRRKHNLGVKL

SEQ ID NO: 9438 - protein, 36 aa, Artificial Sequence
  Computer-generated peptide variant
KMKLMKKWLRLFKRKLLALGRDRLFLDNAVNSNKLY

SEQ ID NO: 9439 - protein, 41 aa, Artificial Sequence
  Computer-generated peptide variant
RIRIFTKMYRYFRKAAPAFLAKMRLARSCANLILAKKMRWS

SEQ ID NO: 9440 - protein, 50 aa, Artificial Sequence
  Computer-generated peptide variant
RIKLMRRFYKFWKTHTGELLAAKMLKGAFPSRAHAKHRYLLLRSRRKVAG

SEQ ID NO: 9441 - protein, 48 aa, Artificial Sequence
  Computer-generated peptide variant
FYKLLRRLFRRFKSEQATPLLAQCARRLMPYNGKAQLARKCRANLAES

SEQ ID NO: 9442 - protein, 74 aa, Artificial Sequence
  Computer-generated peptide variant
KIRLMRKIFRWWHTCRAKTKRQDLRYKKKAAMVLRRPFFLLRMLRAWLRKLDRRLKTRMAANIFSSAQIPLDRP

SEQ ID NO: 9443 - protein, 21 aa, Artificial Sequence
  Computer-generated peptide variant
RLKYMKRLLKLIRTARNFCCA

SEQ ID NO: 9444 - protein, 39 aa, Artificial Sequence
  Computer-generated peptide variant
KLKILCRWYKRFRKTKLRAEALVLPFTIQTAQTKKRRLL

SEQ ID NO: 9445 - protein, 23 aa, Artificial Sequence
  Computer-generated peptide variant
FYKILCKLWKKLKHHLKAGVCLK

SEQ ID NO: 9446 - protein, 29 aa, Artificial Sequence
  Computer-generated peptide variant
IFKMMHRILRRMKRKLRNAVALQRQNLAG

SEQ ID NO: 9447 - protein, 34 aa, Artificial Sequence
  Computer-generated peptide variant
YLRWWRRLFRMFTKKLEAPKPDKRWLDKIAAYLK

SEQ ID NO: 9448 - protein, 31 aa, Artificial Sequence
  Computer-generated peptide variant
RLKMLPRLIRWYSRILRLKRKNQYARKLKLA

SEQ ID NO: 9449 - protein, 30 aa, Artificial Sequence
  Computer-generated peptide variant
LWRMLRKYFKWMKTVAVCQKAARVLQARAL

SEQ ID NO: 9450 - protein, 37 aa, Artificial Sequence
  Computer-generated peptide variant
LLRWFKKIYRRLTRAPWIHIRCKAPKSALAKKAFTAF

SEQ ID NO: 9451 - protein, 50 aa, Artificial Sequence
  Computer-generated peptide variant
WWKWFRKMLKKLNKRLLDKDIMKSARRRLAKCKADAFNKLGNGLKYQSAE

SEQ ID NO: 9452 - protein, 30 aa, Artificial Sequence
  Computer-generated peptide variant
RLRWFSKLWKKLRTLTNTKKKQLLFLLNHP

SEQ ID NO: 9453 - protein, 40 aa, Artificial Sequence
  Computer-generated peptide variant
FFKIMKRYLRMIKKALRKAGRQSRMKLSNVELKHSLLMAA

SEQ ID NO: 9454 - protein, 40 aa, Artificial Sequence
  Computer-generated peptide variant
RIKFLRKLMKWFKRADARAYYHKAKLSGFAKIPWRNSLLQ

SEQ ID NO: 9455 - protein, 79 aa, Artificial Sequence
  Computer-generated peptide variant
KMKLYKRYFKFYRKAALMGKLVEYRNPKAPLKRARALTLASYRALLAEQEGLRNCDMDLALVHQLQTRRRNKLRKALFM

SEQ ID NO: 9456 - protein, 28 aa, Artificial Sequence
  Computer-generated peptide variant
FWRLYSKLLKKLKKGRLHAEVPNLALCE

SEQ ID NO: 9457 - protein, 54 aa, Artificial Sequence
  Computer-generated peptide variant
YLKMWKRLLKYLKSSLIAQQKRILIEFNITLKALKLKARSRANSKKLKRWWATV

SEQ ID NO: 9458 - protein, 32 aa, Artificial Sequence
  Computer-generated peptide variant
RLRMLKRLLKRLKQLMHSLIYGYKPFSAGLAN

SEQ ID NO: 9459 - protein, 60 aa, Artificial Sequence
  Computer-generated peptide variant
LFKMISRFYKMFPKKLALKRRLLAYPAERGTLRRVACARLKFYLAQRWVSYFHLRRLMRC

SEQ ID NO: 9460 - protein, 41 aa, Artificial Sequence
  Computer-generated peptide variant
FFKLLRKLLRRLNRLKRACCLCRQLGSLYEVLQKLLTPMID

SEQ ID NO: 9461 - protein, 29 aa, Artificial Sequence
  Computer-generated peptide variant
RLRLICRLFKFICRKICLMLKALSSKRTA

SEQ ID NO: 9462 - protein, 24 aa, Artificial Sequence
  Computer-generated peptide variant
LLKWWCKLMRLLRQVKDWKARTRL

SEQ ID NO: 9463 - protein, 73 aa, Artificial Sequence
  Computer-generated peptide variant
FMRLWKRYMRKYCCANKLRRLFLLCPLLLKKPLKAHMAGLKKSRLLKERKLKDRVHRLVAKGECPAKPYLAVE

SEQ ID NO: 9464 - protein, 35 aa, Artificial Sequence
  Computer-generated peptide variant
YLKFFSRIIRLYHKAIVTLAPALLKKIAKRELACR

SEQ ID NO: 9465 - protein, 58 aa, Artificial Sequence
  Computer-generated peptide variant
FLRFLRKILRKFCKDLKKVKSDQQMLRLKKLAFTDTNSLCKLSAGKRRSRARANRSHL

SEQ ID NO: 9466 - protein, 69 aa, Artificial Sequence
  Computer-generated peptide variant
KWRFLRKMLRRIKRIHAMLRSQLWHLAAFLKRLCIRLNVRESLLMSPKCKAQRLIAGNVPRRLAFPALA

SEQ ID NO: 9467 - protein, 55 aa, Artificial Sequence
  Computer-generated peptide variant
KMRFLRKFFKLLRSSVDLMHQGFLKLRVLFLFPAFRRRLYLLGLRAHLAPKVRCL

SEQ ID NO: 9468 - protein, 57 aa, Artificial Sequence
  Computer-generated peptide variant
KMKILKKLLRKFHRIFCVGIHLATRARRGAALINFKFRAWLIYEFMRALRHRRKILA

SEQ ID NO: 9469 - protein, 70 aa, Artificial Sequence
  Computer-generated peptide variant
IYRLLKKLFKRWRTAQAKLLHALRLTACELKWNAREEHTKRAFARAADPKVQKWKRAAAGWYFEAAAPAM

SEQ ID NO: 9470 - protein, 70 aa, Artificial Sequence
  Computer-generated peptide variant
RLRLLKKLLKLLKKMALKKKCARIAMLSLEEKNQKPMLGPMCAAAQLYMRKLRCVPDRYATKRLILCDAR

SEQ ID NO: 9471 - protein, 66 aa, Artificial Sequence
  Computer-generated peptide variant
KLKILQKMYKRLRTKLSGNARKRSSAKPKRPAATNQYACRCAAQLDANSLRRRRYADRSTTYLKWA

SEQ ID NO: 9472 - protein, 48 aa, Artificial Sequence
  Computer-generated peptide variant
IMRLFKRFFRRYRKLMLLICTRHLRFDGAQLALCPVERDLRRHAAKAR

SEQ ID NO: 9473 - protein, 48 aa, Artificial Sequence
  Computer-generated peptide variant
LWKLLKKLMKRFRHPMAKLLRALRADHLNCEYYPNARPLVMHRARKVH

SEQ ID NO: 9474 - protein, 79 aa, Artificial Sequence
  Computer-generated peptide variant
RLKMYCRLMRKLSKIDDALYKFAAKLYLIAAARARKRFMRIRIRDHWAVKAQIAAFALCKVRNGMAKYYMSRLANLMML

SEQ ID NO: 9475 - protein, 27 aa, Artificial Sequence
  Computer-generated peptide variant
RLRMLRRMIKLFRSALRQLIRQANTDK

SEQ ID NO: 9476 - protein, 41 aa, Artificial Sequence
  Computer-generated peptide variant
LYKLLQKLYRIWTPCRAMRLKEAYFLQAILKLTRELLMKKF

SEQ ID NO: 9477 - protein, 20 aa, Artificial Sequence
  Computer-generated peptide variant
LFKLWRRFLRLYKNALYKKA

SEQ ID NO: 9478 - protein, 43 aa, Artificial Sequence
  Computer-generated peptide variant
WLKIWCKWYKRYTCKNWWHSCAFLKKAKRKLARCLRLLTRRLP

SEQ ID NO: 9479 - protein, 20 aa, Artificial Sequence
  Computer-generated peptide variant
KLKILPRILKKLKHNVAHAD

SEQ ID NO: 9480 - protein, 44 aa, Artificial Sequence
  Computer-generated peptide variant
RIKMYKRMLKIWHHLAKAPELRKPMRAFLYRAGRAKKAALKVCD

SEQ ID NO: 9481 - protein, 72 aa, Artificial Sequence
  Computer-generated peptide variant
MLKLLCRIMKILCKAKRPRERRVGKSLVARLKRRKSAATRTVYKQKAELLYIGDAAKYINRLNDLKADPRLA

SEQ ID NO: 9482 - protein, 48 aa, Artificial Sequence
  Computer-generated peptide variant
LYKLWRKLLKKLHPRWKADAPPARVCRALRRAWTELKKWARRKAATTV

SEQ ID NO: 9483 - protein, 36 aa, Artificial Sequence
  Computer-generated peptide variant
IFKWIRKLLRIYPCANAIKFNRAARMTRAELKLCLA

SEQ ID NO: 9484 - protein, 51 aa, Artificial Sequence
  Computer-generated peptide variant
LWKMLHKLWKRYKKRKPALFDYRILFWANRLGARKNNAKKNLRKCPKEPLA

SEQ ID NO: 9485 - protein, 36 aa, Artificial Sequence
  Computer-generated peptide variant
LFRYFNRLFRFWKKKRFKDELLNARKLLADARLKKA

SEQ ID NO: 9486 - protein, 39 aa, Artificial Sequence
  Computer-generated peptide variant
MMKYYRRLLRFLRRYKDWRLHARDMAPRLKAVRVAMMVA

SEQ ID NO: 9487 - protein, 27 aa, Artificial Sequence
  Computer-generated peptide variant
RLRFFRRMLKKIKKLTGLAAITTGCYA

SEQ ID NO: 9488 - protein, 78 aa, Artificial Sequence
  Computer-generated peptide variant
IYKLMKKLLKYFKREKRDKRGVERKKTKTKLARQKYCDELHLLLLERAAPQARWRKALALFVEYHRKTKLKQRLRQLV

SEQ ID NO: 9489 - protein, 37 aa, Artificial Sequence
  Computer-generated peptide variant
YLKMFRRYYRKLRKQLKIDKCTWAALLWKAEATRQAL

SEQ ID NO: 9490 - protein, 99 aa, Artificial Sequence
  Computer-generated peptide variant
RLKIFTKLWRLYKNRDTARAKKSKRALWRKASYVNRYAKLALCATAHVFRDKSLKKAHAYKRRRMRPQRKRYWKATLGRKLLATLVAKDRRAAHILRLL

SEQ ID NO: 9491 - protein, 47 aa, Artificial Sequence
  Computer-generated peptide variant
KIKLIKKMLRFYKQYGCRLARGRKMPSPLEKAHKKALLLLHRLQAHP

SEQ ID NO: 9492 - protein, 22 aa, Artificial Sequence
  Computer-generated peptide variant
KFRLLKKLMKFLKHLIVLATKK

SEQ ID NO: 9493 - protein, 58 aa, Artificial Sequence
  Computer-generated peptide variant
WIKFFRKLMKLYNRAPALEDLLDRSQRKIAKARHWLDLNGRLLYILKRRRTAKTMVAR

SEQ ID NO: 9494 - protein, 60 aa, Artificial Sequence
  Computer-generated peptide variant
LFRMFPKLFRKYRQAPQCGMWLLALKLKRLADKLVKRLRGLQFALFKMKKIRWELMFGQA

SEQ ID NO: 9495 - protein, 40 aa, Artificial Sequence
  Computer-generated peptide variant
LYKWFCKIMRRWKNVRGALLLLPRWTLPALLWRTLKAHNL

SEQ ID NO: 9496 - protein, 40 aa, Artificial Sequence
  Computer-generated peptide variant
RLRLFSKFYKRFQRLLSSLPLDRQKHLKIAGKNLKVAMKP

SEQ ID NO: 9497 - protein, 98 aa, Artificial Sequence
  Computer-generated peptide variant
RMRYLRRYMRFFQKLRKFKRTRKNACHRKRKQWGRCPWRARLLKYLSLLMHAILSIGLDDRNLFLEARAHAARRANAKAPRAHQSAAALGAYYIARHE

SEQ ID NO: 9498 - protein, 27 aa, Artificial Sequence
  Computer-generated peptide variant
RLKLWRKFIRKYHKLEATARLWMLFLA

SEQ ID NO: 9499 - protein, 68 aa, Artificial Sequence
  Computer-generated peptide variant
RLRLFRKILKMLCHLRLQLPIACHEKMKYSKNQNGKARLLHRLRRMAFQVNFVTRRRAACARAPMARL

SEQ ID NO: 9500 - protein, 68 aa, Artificial Sequence
  Computer-generated peptide variant
WLRLMRKLWRKLPKMNIPHKKRAFKKAFTLLKKYKLLHFPEDAYVRKANARAYKKMYHAMMLAEKRGR

SEQ ID NO: 9501 - protein, 72 aa, Artificial Sequence
  Computer-generated peptide variant
IYRLFPKFIRRFRRRDPNCLDKQALHRKALLNRAKPFLSKQVTKKLKLPNKRCRLEGNNLLKSLLAFAKLHN

SEQ ID NO: 9502 - protein, 97 aa, Artificial Sequence
  Computer-generated peptide variant
KLKIFSRFLKFLRCLKPREAILNRAEIRTLQKQRQKKVPLDWARRREKHRDLAASRRLFSRLDKHRAAGLRRVNKLVWDHCARANLYTYAKKELNLH

SEQ ID NO: 9503 - protein, 44 aa, Artificial Sequence
  Computer-generated peptide variant
LIRFLHKMLRLFRSHWAVEKAVRKYAKKRLEKHLASKKATLNPT

SEQ ID NO: 9504 - protein, 41 aa, Artificial Sequence
  Computer-generated peptide variant
FLKIMKRFLRWLRTRNLLFLKAREPMRAQKPTLRVKCVAEK

SEQ ID NO: 9505 - protein, 38 aa, Artificial Sequence
  Computer-generated peptide variant
YLKFMKRYFKLYRRFLRVRHLKLYALACRCNKTLAQRM

SEQ ID NO: 9506 - protein, 29 aa, Artificial Sequence
  Computer-generated peptide variant
KLKLLTRFIRIYKKRHYRLCALCWQKFLT

SEQ ID NO: 9507 - protein, 50 aa, Artificial Sequence
  Computer-generated peptide variant
MYKWFKKMLRRWRRRRLDLHRMRLLDMALVFTLMKRAMIKFNAFLPLKTL

SEQ ID NO: 9508 - protein, 44 aa, Artificial Sequence
  Computer-generated peptide variant
RFKYFKRFFRKLQCLCGKRAQWAISQALRYTRMHARAAKRKAWA

SEQ ID NO: 9509 - protein, 34 aa, Artificial Sequence
  Computer-generated peptide variant
MFKFLSKLLKFLRHWFWRKAYRLKKMLLWHQARD

SEQ ID NO: 9510 - protein, 30 aa, Artificial Sequence
  Computer-generated peptide variant
FLRIIRKLLKKIKKACAKKRLSNRLACHLN

SEQ ID NO: 9511 - protein, 25 aa, Artificial Sequence
  Computer-generated peptide variant
LLRLIQRYIKRFRRLAACCKFQRHT

SEQ ID NO: 9512 - protein, 39 aa, Artificial Sequence
  Computer-generated peptide variant
RIRLYQRLLKFWKKKALAHEKAKILNWAAYKSAGWIQAA

SEQ ID NO: 9513 - protein, 50 aa, Artificial Sequence
  Computer-generated peptide variant
RLKLIRKLMRKWTRKERLPADSRLLVFLRLNVNACDAQAVALIHAYDKKE

SEQ ID NO: 9514 - protein, 42 aa, Artificial Sequence
  Computer-generated peptide variant
RIKMLTKYFRLYRRRLRKRTLRMAAGLALRNHLAVIQRFFRH

SEQ ID NO: 9515 - protein, 36 aa, Artificial Sequence
  Computer-generated peptide variant
RIRLMPKLMKKLQKKGRRRAAPLPPLLRPTETLQRA

SEQ ID NO: 9516 - protein, 34 aa, Artificial Sequence
  Computer-generated peptide variant
KFRLFRKYLKRLRQAEHKIANPLVALSHTGRAKY

SEQ ID NO: 9517 - protein, 31 aa, Artificial Sequence
  Computer-generated peptide variant
KMKMLRRFLRKMRKAARALCPRYGRIALFHM

SEQ ID NO: 9518 - protein, 50 aa, Artificial Sequence
  Computer-generated peptide variant
RLKFIRRMMRKFRHLPAKKLSIMIARAMFMHGVFPALKRALLRRLLKPKY

SEQ ID NO: 9519 - protein, 95 aa, Artificial Sequence
  Computer-generated peptide variant
KIRLFPKMYRLLTPWFSALVCAHRARYLNHRSRPRKEWFMLAHLHLTWAAKSAPLLKRSARKRKALYCIIKQRLRRCKAHGLFQEFRNRALKARA

SEQ ID NO: 9520 - protein, 34 aa, Artificial Sequence
  Computer-generated peptide variant
YLKLFCKFLRRLKRKLTAKGDCYHKANCRDAVCL

SEQ ID NO: 9521 - protein, 34 aa, Artificial Sequence
  Computer-generated peptide variant
RIKLLKRMLRMFKKDRNLALDLAFRPIRLLSRCD

SEQ ID NO: 9522 - protein, 38 aa, Artificial Sequence
  Computer-generated peptide variant
LLKLIKRYYRMFKKSRIKRVGLGRRLAAHALAWRPERF

SEQ ID NO: 9523 - protein, 60 aa, Artificial Sequence
  Computer-generated peptide variant
LLRLLKKMFRLWNKGRMLATRDYARYKREFLRLKCRNRTAAKRDEMKCGCAAGEARADKL

SEQ ID NO: 9524 - protein, 92 aa, Artificial Sequence
  Computer-generated peptide variant
KLRFLRRLWKIMNRHAAKRYKKILYRHLCEARRLECEFCAQRKLEFAAWAHKKKAPRILRYVLAKLKSALHAKKHRDIAVIKALDWHWAARL

SEQ ID NO: 9525 - protein, 26 aa, Artificial Sequence
  Computer-generated peptide variant
KLRLYHRFYKKLKTFLLAECWKAAKN

SEQ ID NO: 9526 - protein, 22 aa, Artificial Sequence
  Computer-generated peptide variant
RFKLLRRIWKLFRTLLNRNQFA

SEQ ID NO: 9527 - protein, 32 aa, Artificial Sequence
  Computer-generated peptide variant
MWKYYRRLLKKWRQYKKLIARAAAIAEKDHRS

SEQ ID NO: 9528 - protein, 85 aa, Artificial Sequence
  Computer-generated peptide variant
MLKFLNRIFRKLKNLKLKCHLADMAPWFKARLRYAQYLRMHLTVKEWLRHRAVLALARSQKRLTVRMAARVTSRKVWWKLKSKVW

SEQ ID NO: 9529 - protein, 67 aa, Artificial Sequence
  Computer-generated peptide variant
RLRYFKKFLRLLRRQDRALRLAGALLHAENIARERKNKIAMYARDGLMKSFQEARIFFITLALKVRN

SEQ ID NO: 9530 - protein, 21 aa, Artificial Sequence
  Computer-generated peptide variant
LFRYLCKMFKRWKPKDFAALK

SEQ ID NO: 9531 - protein, 54 aa, Artificial Sequence
  Computer-generated peptide variant
KLRWYKKMLKYFKRFKYWRFIKGKELNMAKDALLWTLRKHLAKWAHFAARARNG

SEQ ID NO: 9532 - protein, 29 aa, Artificial Sequence
  Computer-generated peptide variant
KLRLMSRIMKLFRKQKSKSLYKTLVHLDA

SEQ ID NO: 9533 - protein, 44 aa, Artificial Sequence
  Computer-generated peptide variant
RLRLMSRMYKKMKKSKRALTSAVASALKKYPYPGLLATRACTLA

SEQ ID NO: 9534 - protein, 33 aa, Artificial Sequence
  Computer-generated peptide variant
RMRWLRRMFKKLRSLLLCRWLCYCKRMEIRAAP

SEQ ID NO: 9535 - protein, 34 aa, Artificial Sequence
  Computer-generated peptide variant
KLKYWKKLIRRLKPKHKRWAAESGTLLRLQSAAN

SEQ ID NO: 9536 - protein, 32 aa, Artificial Sequence
  Computer-generated peptide variant
KLKLFSKFLRKWRKRLECGAGRASPGRLTLLL

SEQ ID NO: 9537 - protein, 55 aa, Artificial Sequence
  Computer-generated peptide variant
RMRLLPRWWKKFPKLVAGAVAKLALTIVRLLKKRPMKKWILNHYFRKLRKVACFA

SEQ ID NO: 9538 - protein, 34 aa, Artificial Sequence
  Computer-generated peptide variant
LMKFFRKWLKKFKQRASYKRKARLKLALDELRCL

SEQ ID NO: 9539 - protein, 43 aa, Artificial Sequence
  Computer-generated peptide variant
LFRFIKRLLRMLHKLLFECCRLARAKEMVAKCDPLRDRLPVTA

SEQ ID NO: 9540 - protein, 28 aa, Artificial Sequence
  Computer-generated peptide variant
RFRWLNRLWKKMPQKLQRLSPFHRLLAA

SEQ ID NO: 9541 - protein, 21 aa, Artificial Sequence
  Computer-generated peptide variant
RIKFYCRLMRWLTRMAKADLA

SEQ ID NO: 9542 - protein, 29 aa, Artificial Sequence
  Computer-generated peptide variant
RLRWYKKFFKWISRHLLYAGELTAAKMKL

SEQ ID NO: 9543 - protein, 84 aa, Artificial Sequence
  Computer-generated peptide variant
LLRLFKKFWKIYKKRAFARAMIISKARKKREKYARRRHRAANLRKRKNDDKALLCWPLYLMHRNLGGRARDSKHQSLMQELLRK

SEQ ID NO: 9544 - protein, 40 aa, Artificial Sequence
  Computer-generated peptide variant
KYKMLKRLLRRLKRRIWPAHNLDCVAYLKRSIWLLALGLK

SEQ ID NO: 9545 - protein, 27 aa, Artificial Sequence
  Computer-generated peptide variant
LIRFYKKFLRKLKRMARTLLIALAWEN

SEQ ID NO: 9546 - protein, 39 aa, Artificial Sequence
  Computer-generated peptide variant
KLKILHRLLKMIRRRQRNNNKDLHALAVLRQATARDKAL

SEQ ID NO: 9547 - protein, 26 aa, Artificial Sequence
  Computer-generated peptide variant
LFRIYKRLLRRLKNYCAIHRHMRLLR

SEQ ID NO: 9548 - protein, 25 aa, Artificial Sequence
  Computer-generated peptide variant
RFKILRKILKFLHKACDPLLRKLVY

SEQ ID NO: 9549 - protein, 70 aa, Artificial Sequence
  Computer-generated peptide variant
LLRFMKKYYRKIRTLIHQVLGIVARKRKALRQAKCKRKLLEAAHHKKRVAKCAKIKGEYYLATLYKQDLR

SEQ ID NO: 9550 - protein, 78 aa, Artificial Sequence
  Computer-generated peptide variant
LYRLLRKMLRFLRKSRLAAVWSLPHPLLAKFEEKKKLALQTCAKSLECCQEKPLAGRRKTSCMEFLADAVRPRRAKAR

SEQ ID NO: 9551 - protein, 87 aa, Artificial Sequence
  Computer-generated peptide variant
LWKFYKRLWKKFTKRLKRKKNWLNLCLLHGNWCRLRCLEFEKMAWAAYRYIAILRLYCRLLKYAKTRARALGKLWLKKISAECCQKR

SEQ ID NO: 9552 - protein, 23 aa, Artificial Sequence
  Computer-generated peptide variant
KLRWLKRILKKLQKKAYSNPATY

SEQ ID NO: 9553 - protein, 63 aa, Artificial Sequence
  Computer-generated peptide variant
LLKLMSKMYRKLKHRCAQKTYHKKLRALMDAKNLTRNFKRLTLRPAQPLRQHLVEWRYRLTKL

SEQ ID NO: 9554 - protein, 60 aa, Artificial Sequence
  Computer-generated peptide variant
FIRMITRLMKLFRKCYKEKRKKHMCIWRCRDNLHRTQRLKARLLAKQLKMLRLARADPPA

SEQ ID NO: 9555 - protein, 45 aa, Artificial Sequence
  Computer-generated peptide variant
LLKMFPKWMRILPQQKTARKAKFSLERRDKVPRLRALERIASKRA

SEQ ID NO: 9556 - protein, 46 aa, Artificial Sequence
  Computer-generated peptide variant
LIKMFKKFFKIFRRRQKRTALGLLCLKRARECARVWMWAKWLYLKL

SEQ ID NO: 9557 - protein, 32 aa, Artificial Sequence
  Computer-generated peptide variant
LIRWFRKYIKKMQNRKLIFRLLQYSARLALRA

SEQ ID NO: 9558 - protein, 52 aa, Artificial Sequence
  Computer-generated peptide variant
RFRLYSKLMRFLRRFINKGKLCRALGKAHIRWKLLALCRHLAAIACAWERDR

SEQ ID NO: 9559 - protein, 31 aa, Artificial Sequence
  Computer-generated peptide variant
KFKLFRRFWKLFRPGVRAIEKRELLILCLAK

SEQ ID NO: 9560 - protein, 65 aa, Artificial Sequence
  Computer-generated peptide variant
LYRFLPRLWKKFPKRWAYMTSAALKLPRWRMNRKNLEVLPLRARRRTFNAGKLLQFAAALQKTVA

SEQ ID NO: 9561 - protein, 60 aa, Artificial Sequence
  Computer-generated peptide variant
RFKFIKKFLKLFKKAAAADKREPKKKVAKRTWNTLADYEGAIRKLAKRLPNEDCKLFLRV

SEQ ID NO: 9562 - protein, 25 aa, Artificial Sequence
  Computer-generated peptide variant
LIKYLKRFWKLLKQKFRRTNRLAAV

SEQ ID NO: 9563 - protein, 35 aa, Artificial Sequence
  Computer-generated peptide variant
RFRLFKRLYRRYKRFPPAKPQQTRLKAMMILLLLL

SEQ ID NO: 9564 - protein, 49 aa, Artificial Sequence
  Computer-generated peptide variant
RMKLFKKMYRKICSALNAAKAVLGRQWTQARGDLRAEKMSSPAKVLLKA

SEQ ID NO: 9565 - protein, 30 aa, Artificial Sequence
  Computer-generated peptide variant
KLRWLKKLYKWLQTKLTNVLKTPNRAKSGR

SEQ ID NO: 9566 - protein, 56 aa, Artificial Sequence
  Computer-generated peptide variant
KLKFLRKFIRMLRRAWVPAVAYDSDNLKAYMRAFEAGSARRRAKCRWRLCSALCTA

SEQ ID NO: 9567 - protein, 45 aa, Artificial Sequence
  Computer-generated peptide variant
RFKLLSRFWKRMNRACKKKACLLLCALMMVRASTKKEKILRARKT

SEQ ID NO: 9568 - protein, 46 aa, Artificial Sequence
  Computer-generated peptide variant
RLKLIKRLLKLIHKKWEHLKKRAIGRIKRVAMLSKESVILLALARL

SEQ ID NO: 9569 - protein, 31 aa, Artificial Sequence
  Computer-generated peptide variant
RWKMIKRLFRRFHRKNADAAKIAMKLAVKQA

SEQ ID NO: 9570 - protein, 72 aa, Artificial Sequence
  Computer-generated peptide variant
LWKLITKMLRMFKRSKFNRQLRSFAQARIDRSKCAKLALIVGKRFKDAKHKFKWLFALANATKNRKAKRQAY

SEQ ID NO: 9571 - protein, 25 aa, Artificial Sequence
  Computer-generated peptide variant
KFKFYRKIFKLLRSKALTPAYATCK

SEQ ID NO: 9572 - protein, 45 aa, Artificial Sequence
  Computer-generated peptide variant
RWRFLRRLFRFLCRPAKWLLLLLRAAKQHRLRVNMLTLHRLVEMC

SEQ ID NO: 9573 - protein, 48 aa, Artificial Sequence
  Computer-generated peptide variant
MIRLWRRLMRKFRRLAHQDPELRLRLARKRIRKANCALRWARWAPNVT

SEQ ID NO: 9574 - protein, 84 aa, Artificial Sequence
  Computer-generated peptide variant
KLRLLSKFFRRFQKKKRQPPMALKAAAGAEPYLAMPACDALARWRPLKWVLLQAPLMRAHPKTILRKAAKAARMDRRLATRCAL

SEQ ID NO: 9575 - protein, 35 aa, Artificial Sequence
  Computer-generated peptide variant
MFKLLKKYYKRLRRWRLKARRAAMLFTAWYYQRHQ

SEQ ID NO: 9576 - protein, 27 aa, Artificial Sequence
  Computer-generated peptide variant
RWRLYKRYLRKFNRAKFGLAAGASFRW

SEQ ID NO: 9577 - protein, 69 aa, Artificial Sequence
  Computer-generated peptide variant
RWRYITRLWRFLRKKRKPTCQASLRAFKLAQADGLKALNMSSILRMLKRMKHMILCRKNYDLAEAHKAK

SEQ ID NO: 9578 - protein, 25 aa, Artificial Sequence
  Computer-generated peptide variant
KLRWLQRLMRLFRRRVVLSVRPAPS

SEQ ID NO: 9579 - protein, 51 aa, Artificial Sequence
  Computer-generated peptide variant
KLRMLCKMLKFLSRLKAQQEAFGLAKRRLWDRTPFEWWVRLHRAARKLARL

SEQ ID NO: 9580 - protein, 29 aa, Artificial Sequence
  Computer-generated peptide variant
RFKLLKRFMRMLHKLCRHYLHYVRLKGLY

SEQ ID NO: 9581 - protein, 28 aa, Artificial Sequence
  Computer-generated peptide variant
KLRFWTKWIRKLKREAADCMLLALLRFA

SEQ ID NO: 9582 - protein, 47 aa, Artificial Sequence
  Computer-generated peptide variant
KMRYLRRLWRFMRPWLQVDSAFKAKTLLADRLCLARYRYVNHPLRLA

SEQ ID NO: 9583 - protein, 49 aa, Artificial Sequence
  Computer-generated peptide variant
RLKLMRRMIKRITKEKVFILLTALREHRKYANKLYKHMANLLKLRTPLK

SEQ ID NO: 9584 - protein, 37 aa, Artificial Sequence
  Computer-generated peptide variant
WLKWLKRWLKKMHNHANAAPWKKLATCKTTRALRKKK

SEQ ID NO: 9585 - protein, 40 aa, Artificial Sequence
  Computer-generated peptide variant
KMKLWCRIFKRYNPRWVHCESLGLRLMLLRALRRLAKFNR

SEQ ID NO: 9586 - protein, 26 aa, Artificial Sequence
  Computer-generated peptide variant
WFKLFKKFFRLLRRCAGNELAHAHRK

SEQ ID NO: 9587 - protein, 88 aa, Artificial Sequence
  Computer-generated peptide variant
KFRIFNRLLKKLRQDKLKKAARRPVKKGSIASGNGPWRLIMRKRLIKWSRKKNTKAWLAFKVMIKSHKKYHTLLLASRARALTLYLAS

SEQ ID NO: 9588 - protein, 47 aa, Artificial Sequence
  Computer-generated peptide variant
LLKWLKRFIKKMKRMAWAGAQMRPFAQFSRCGLDLADRKVKRVAKCA

SEQ ID NO: 9589 - protein, 20 aa, Artificial Sequence
  Computer-generated peptide variant
RLRFIRKFLKLYSKDNIDLA

SEQ ID NO: 9590 - protein, 68 aa, Artificial Sequence
  Computer-generated peptide variant
KLRLMRRLLRKIQRKLQKPRKTLARHLRRRSRKDNTDEAYNPNLCKHALSFWVLKYTMAQVLRTRKFL

SEQ ID NO: 9591 - protein, 46 aa, Artificial Sequence
  Computer-generated peptide variant
RMKLYCKLFRRLKKSRACKGRNKGLFKACYKTLWRKLWALLPMKQA

SEQ ID NO: 9592 - protein, 46 aa, Artificial Sequence
  Computer-generated peptide variant
RLRLLQKYLRRYKRMRRLRLNVKLPLFDLLYARNQNQRRRINQAWF

SEQ ID NO: 9593 - protein, 44 aa, Artificial Sequence
  Computer-generated peptide variant
RLRLMTKLYRRFRSLELKAMRARMKKNASLVTAFNEFRRAADPW

SEQ ID NO: 9594 - protein, 30 aa, Artificial Sequence
  Computer-generated peptide variant
KLKLLKRLYRLMRHWNIALDADVDITRFKK

SEQ ID NO: 9595 - protein, 71 aa, Artificial Sequence
  Computer-generated peptide variant
RLKWFCRLWKKFKKALLFLHKLKLFWLGLGPLHNAVGVLRVLHKKDRNAGFHRRAAMPLRLSVMLRKKKQI

SEQ ID NO: 9596 - protein, 34 aa, Artificial Sequence
  Computer-generated peptide variant
LLRFLKRLIRMYCKLAKDRAAHHRLAKHKMSRDL

SEQ ID NO: 9597 - protein, 92 aa, Artificial Sequence
  Computer-generated peptide variant
RLKIWRKLFKIWKRRRGKLHRRKHLVKLPTMLAKHCIIAARNKLAAGGLSLCSVLTACKILKRHDVSAIREADLKEPRKAKKFASEKMLRRK

SEQ ID NO: 9598 - protein, 43 aa, Artificial Sequence
  Computer-generated peptide variant
MMKYFCKIFKRMKKLELRKRGQCGALADPARLEKLKANAKILA

SEQ ID NO: 9599 - protein, 32 aa, Artificial Sequence
  Computer-generated peptide variant
KFKILKRLIRRWRTKDQGRMLKLRLFLYALHL

SEQ ID NO: 9600 - protein, 66 aa, Artificial Sequence
  Computer-generated peptide variant
RYRYLKRLFKLLKNMAKLYAAWKAKDKLMKHNGKLNWLHMLKIQWLAASHKKENAAWLFWWVKRRK

SEQ ID NO: 9601 - protein, 82 aa, Artificial Sequence
  Computer-generated peptide variant
MLKFLQKIFKMMPTMCKAYDALELWANKRFPKAKPLQLFLALALYLLWRGRLRLRLRPLRKERRRVSRVLKRLVSKAGRART

SEQ ID NO: 9602 - protein, 81 aa, Artificial Sequence
  Computer-generated peptide variant
RWKLFKKLLRRMKRKLKKQRARTELNVCAKMSMAARGNKSCAECLRRICKLMMAKFAAKRSCKAQNKLETWAMYWRKFALG

SEQ ID NO: 9603 - protein, 20 aa, Artificial Sequence
  Computer-generated peptide variant
FWRLLKRLMRRLKRQNLAQC

SEQ ID NO: 9604 - protein, 47 aa, Artificial Sequence
  Computer-generated peptide variant
KLKLLKKFFKRLCNAKRLALMEIYLTAGESDRLWFLKFLKWCADQRY

SEQ ID NO: 9605 - protein, 30 aa, Artificial Sequence
  Computer-generated peptide variant
YWRLFHRWFKRFHRALVRQRSLDALKAALL

SEQ ID NO: 9606 - protein, 20 aa, Artificial Sequence
  Computer-generated peptide variant
LLKFMKKLFKKLCKLRALFA

SEQ ID NO: 9607 - protein, 31 aa, Artificial Sequence
  Computer-generated peptide variant
RFKLFNKWLRLMKRALQLLAMIRRVWKIQKA

SEQ ID NO: 9608 - protein, 33 aa, Artificial Sequence
  Computer-generated peptide variant
KLKMMCRIWRRFTTRKRLWLAAALGDLFLCKIA

SEQ ID NO: 9609 - protein, 66 aa, Artificial Sequence
  Computer-generated peptide variant
LFKFFRRWLRRMKNLWANDAKALARERYEPLSYRQIAIHIRAAPTKALKARMRANEAARYKETNKA

SEQ ID NO: 9610 - protein, 73 aa, Artificial Sequence
  Computer-generated peptide variant
IWRIFRRWFRMLRKMLLKAPDKKRKLAKWNRSCGALKECWKLRMKCATCRWKTKIKLAARAQLVALLLKRGVA

SEQ ID NO: 9611 - protein, 55 aa, Artificial Sequence
  Computer-generated peptide variant
LIKIIRRYFRRLTKAAVVKRLKCLAKRLRLMLHFVDARIALKANHDAKLWLNTVF

SEQ ID NO: 9612 - protein, 55 aa, Artificial Sequence
  Computer-generated peptide variant
IIKLMHKLYRRFKRRAAKMSFLAAKQRGPLLVLDARQARGKMRRLKRLSAQRRSS

SEQ ID NO: 9613 - protein, 29 aa, Artificial Sequence
  Computer-generated peptide variant
KLKLLNRFLKKYKRIALLKVWPKGSLWVR

SEQ ID NO: 9614 - protein, 69 aa, Artificial Sequence
  Computer-generated peptide variant
RMKWYKRLMRKYQHHKLGRAAKADRNLKDLSSPLRLRNPDPMKLLALNPLLLHKATGLMAWPIKAMWKR

SEQ ID NO: 9615 - protein, 29 aa, Artificial Sequence
  Computer-generated peptide variant
YIRFWCKLLKRIKSKAAMQLLLLMLATRR

SEQ ID NO: 9616 - protein, 20 aa, Artificial Sequence
  Computer-generated peptide variant
KLKYYSKWLKLLKKCLMLPL

SEQ ID NO: 9617 - protein, 53 aa, Artificial Sequence
  Computer-generated peptide variant
KIRWLRRFFKRLTKAMCRKALKAFCHKKTRPLRYKEWGAALCHAGPKLMAGRK

SEQ ID NO: 9618 - protein, 29 aa, Artificial Sequence
  Computer-generated peptide variant
WLRLLRKYLKKYQRLTLFNMKLVDRELPW

SEQ ID NO: 9619 - protein, 27 aa, Artificial Sequence
  Computer-generated peptide variant
LWKFYKKWFRYFRRKALSNTAARFHAA

SEQ ID NO: 9620 - protein, 60 aa, Artificial Sequence
  Computer-generated peptide variant
KLRLYPKLLKYIPKGAVLYFKNLKQIWAARRAEYKLQTGKVRLLATRSKPKLAKAFYEQM

SEQ ID NO: 9621 - protein, 37 aa, Artificial Sequence
  Computer-generated peptide variant
KLRMLNRLFKFIRHPWRFPRNQARRAERATRAALALT

SEQ ID NO: 9622 - protein, 40 aa, Artificial Sequence
  Computer-generated peptide variant
RWRLLPKWWRILTRARGIRKAAVVLVCMKKEDALFAFRLT

SEQ ID NO: 9623 - protein, 25 aa, Artificial Sequence
  Computer-generated peptide variant
ILKWIRKFYRMFRRQHAHALLAKAT

SEQ ID NO: 9624 - protein, 28 aa, Artificial Sequence
  Computer-generated peptide variant
LYRLWPRWYRLFKRQANRRNRATAGLRS

SEQ ID NO: 9625 - protein, 71 aa, Artificial Sequence
  Computer-generated peptide variant
FLKLYKRFYRKFRKRCKAFRSCRGAATLFGSLARLMLVASRANARKLLKQWYGRGGDRDAWKLARLGWRKK

SEQ ID NO: 9626 - protein, 50 aa, Artificial Sequence
  Computer-generated peptide variant
YFKWFKRFIRFLKTLRLALKRAKHATLLWAPFCFLKVAAPRTNRLATGAK

SEQ ID NO: 9627 - protein, 36 aa, Artificial Sequence
  Computer-generated peptide variant
RFRWLQKFLKFLQKEAMKCHKLWRVTLWLILGKLAR

SEQ ID NO: 9628 - protein, 21 aa, Artificial Sequence
  Computer-generated peptide variant
FFRLLRRYLKKWRTLNRAAAP

SEQ ID NO: 9629 - protein, 21 aa, Artificial Sequence
  Computer-generated peptide variant
WIRWLQKFMRRLRRHWAARAD

SEQ ID NO: 9630 - protein, 74 aa, Artificial Sequence
  Computer-generated peptide variant
LFRLYPKLLKKIKNALAYKLAWFLFQALKIRSPCAKHQRALCRHALKDKYAWLDLFRYAASIGLKGNYPFKRKH

SEQ ID NO: 9631 - protein, 48 aa, Artificial Sequence
  Computer-generated peptide variant
KLKWYRKILRMLKKLAAFMLRKFQKQPAARIEDYKKLTAHLYSACFAK

SEQ ID NO: 9632 - protein, 42 aa, Artificial Sequence
  Computer-generated peptide variant
LIRLWKRLYKKWKTHRRKLEVARAPKKAHAAVYTCLLAHQMA

SEQ ID NO: 9633 - protein, 51 aa, Artificial Sequence
  Computer-generated peptide variant
RLRLWKRFFKLFKTLEWLWRLGRRWKRGRGQLAEALCFYLARANRKRVQLR

SEQ ID NO: 9634 - protein, 34 aa, Artificial Sequence
  Computer-generated peptide variant
RMKMFKRLMRRWKCLEKRAMKALVQDKDAAANPF

SEQ ID NO: 9635 - protein, 44 aa, Artificial Sequence
  Computer-generated peptide variant
RIRFIRKILKKMNHGFKYRRRGKLKIALWKLDATGDLAGLARVA

SEQ ID NO: 9636 - protein, 28 aa, Artificial Sequence
  Computer-generated peptide variant
LLKFLKRWYRIFQKELKDMKMKLNLRFL

SEQ ID NO: 9637 - protein, 79 aa, Artificial Sequence
  Computer-generated peptide variant
KIKWWKRLLKFLSKKRGKRIDKHHAADWQMNYCLHADLRARAAVHRDALNDAEGRQDRRRRYNRKKKAACAAMLLRYLK

SEQ ID NO: 9638 - protein, 37 aa, Artificial Sequence
  Computer-generated peptide variant
KYKLWKRYFRKLNRLVGRRATKLTAAEAFATAAARAN

SEQ ID NO: 9639 - protein, 47 aa, Artificial Sequence
  Computer-generated peptide variant
RLKLFRRLYRKFNKIGRASALAKCCKSAGREFLLYRLIARKAMQADA

SEQ ID NO: 9640 - protein, 31 aa, Artificial Sequence
  Computer-generated peptide variant
IFKMMNKILRLYKSVVRLTCLLILRRRRLKA

SEQ ID NO: 9641 - protein, 30 aa, Artificial Sequence
  Computer-generated peptide variant
LLKFLRRWFRRFRRAHAKKLKTVIMLQNLA

SEQ ID NO: 9642 - protein, 25 aa, Artificial Sequence
  Computer-generated peptide variant
YYRYFHRLLKKWKPLPAMRFARHRL

SEQ ID NO: 9643 - protein, 25 aa, Artificial Sequence
  Computer-generated peptide variant
MLRFWHRLLRRWKQPRKLALCVLTW

SEQ ID NO: 9644 - protein, 25 aa, Artificial Sequence
  Computer-generated peptide variant
KYKWFQRLLRYFKTRALLALQTLRN

SEQ ID NO: 9645 - protein, 27 aa, Artificial Sequence
  Computer-generated peptide variant
YLRLFKKIFKIIKKNTKELATDLMAAK

SEQ ID NO: 9646 - protein, 58 aa, Artificial Sequence
  Computer-generated peptide variant
KLKWFKRWLRYFSRRIWRWEAKCMAGRRLRFQLRGLGLSAIRRATVWAYKKEHARLIL

SEQ ID NO: 9647 - protein, 65 aa, Artificial Sequence
  Computer-generated peptide variant
KYRFLRRLFRMFKRLMFAFFLKIGAGLLAKPRRWYKFKARAPERACQRRGAKAAAANVGDHCQAD

SEQ ID NO: 9648 - protein, 63 aa, Artificial Sequence
  Computer-generated peptide variant
FMRLFRKLLKRMTSAAHKAVPNKIRKLLKKKPTALRWLIARFFFIKLADCYRLHAKAMRMAPE

SEQ ID NO: 9649 - protein, 71 aa, Artificial Sequence
  Computer-generated peptide variant
LYKLMCKMFKKLKKLEWMRARPIRWHRLAVAKKPMRAWGAAKRAMNHKDLLMSKIAIKLLKKATLKRYNHT

SEQ ID NO: 9650 - protein, 69 aa, Artificial Sequence
  Computer-generated peptide variant
FFKFINKLLKKFKKSKRVAQLLHAAIYLLIERLRYKHLHRLNFRRRKKLTALLVDLATQHQIMRKNCMK

SEQ ID NO: 9651 - protein, 38 aa, Artificial Sequence
  Computer-generated peptide variant
ILRFLQRLWRRLTKLHCVAKATHRLIADANRPQLKHHA

SEQ ID NO: 9652 - protein, 57 aa, Artificial Sequence
  Computer-generated peptide variant
RFKWLQKFIRFYRHALARDIRCPKIFRALIWKCKFHRLAEAALKQKHPLLAAARWGL

SEQ ID NO: 9653 - protein, 20 aa, Artificial Sequence
  Computer-generated peptide variant
IYRLFKKYFRRLNKAPQIAL

SEQ ID NO: 9654 - protein, 38 aa, Artificial Sequence
  Computer-generated peptide variant
RYRMICRYLRRMHQKLKALAARAIPLWEANKRFAGHFR

SEQ ID NO: 9655 - protein, 23 aa, Artificial Sequence
  Computer-generated peptide variant
KLRYFKRFLRYLKQFLKAELIHA

SEQ ID NO: 9656 - protein, 52 aa, Artificial Sequence
  Computer-generated peptide variant
KWKMMRKFFRYLRRLFLFLIYRLKKWSAELAPKMLLRWKDHKWAYAGISLRA

SEQ ID NO: 9657 - protein, 29 aa, Artificial Sequence
  Computer-generated peptide variant
KFKYMRKIFKLLQTYLKMLAKKFTLYVKA

SEQ ID NO: 9658 - protein, 46 aa, Artificial Sequence
  Computer-generated peptide variant
KFRFWRKFYRKLKKLLAAMHKRAWKHALWVAARGPRALTAHVIKVS

SEQ ID NO: 9659 - protein, 34 aa, Artificial Sequence
  Computer-generated peptide variant
RLKWLRRLWKMLRRELWPNPRARCLTLVKNSIKM

SEQ ID NO: 9660 - protein, 45 aa, Artificial Sequence
  Computer-generated peptide variant
KFKWLKRLFKLMHRNRRLKLWGRDQIAAKAGKTPIMLLYLHKELY

SEQ ID NO: 9661 - protein, 45 aa, Artificial Sequence
  Computer-generated peptide variant
KFRFLTRLMKLLKKYARQSRAREDMAKKAATARNYLCALYQAWFN

SEQ ID NO: 9662 - protein, 44 aa, Artificial Sequence
  Computer-generated peptide variant
RFKMLRKLLRRWKKNEWYKAGCLHRAAAKGMARWLLSKAYIFNI

SEQ ID NO: 9663 - protein, 46 aa, Artificial Sequence
  Computer-generated peptide variant
RFKYYPRFLRLLKKLYPNVHAYKAKRADLRHILPQRTMSLLALHKR

SEQ ID NO: 9664 - protein, 21 aa, Artificial Sequence
  Computer-generated peptide variant
RFKIFKKLYRRWHKLATYLAH

SEQ ID NO: 9665 - protein, 43 aa, Artificial Sequence
  Computer-generated peptide variant
YFKYICRFMRRLRKLAIRAKKAEKGLALIFRALANQVGVALSH

SEQ ID NO: 9666 - protein, 44 aa, Artificial Sequence
  Computer-generated peptide variant
YFRLLKKLIRRYQRLAHWAKLTLDNADHLKRQRLRKLFAQRCER

SEQ ID NO: 9667 - protein, 20 aa, Artificial Sequence
  Computer-generated peptide variant
FYRLLTRLFKILNKNRFMKL

SEQ ID NO: 9668 - protein, 97 aa, Artificial Sequence
  Computer-generated peptide variant
LLRYYRKWWRRLRKRLYGRCKWDLPNAVKRAKHSRLAPTAKWLRAFTRFRPLSRRAWLAKHKAPLMCKNRAKALIHQRVAKNARHHVTSAAKLNGGY

SEQ ID NO: 9669 - protein, 94 aa, Artificial Sequence
  Computer-generated peptide variant
RMRIYRRLFRKLNTCRAKNKCWEMKMLRAAVADLARLGAFHKIACLRLKLVGPKSARRPDCRYWAPIRRGSLLRARKPRMLRRTQVKIKNSRAQ

SEQ ID NO: 9670 - protein, 31 aa, Artificial Sequence
  Computer-generated peptide variant
RFRFMHRFLRRLKQWAARALGGRSKQARHAE

SEQ ID NO: 9671 - protein, 33 aa, Artificial Sequence
  Computer-generated peptide variant
LLKFYKRMLRLLRKNFIRKLKFQSCRAVEKTMA

SEQ ID NO: 9672 - protein, 20 aa, Artificial Sequence
  Computer-generated peptide variant
RFRLLSRLMKKWRKPHGLGA

SEQ ID NO: 9673 - protein, 38 aa, Artificial Sequence
  Computer-generated peptide variant
LIKFWRKYLKRWRTIRPQLARLCPLRKVRPMATLCRAP

SEQ ID NO: 9674 - protein, 26 aa, Artificial Sequence
  Computer-generated peptide variant
RWRILHRLWKRFKRTPRTNAAALAKL

SEQ ID NO: 9675 - protein, 40 aa, Artificial Sequence
  Computer-generated peptide variant
LLRLLPRFIRKFNRFLMHKVAEIPKNKRQALLFLAADAHY

SEQ ID NO: 9676 - protein, 37 aa, Artificial Sequence
  Computer-generated peptide variant
LMKFIKRILKMLRRLAPANLGKKRFYNEKLSALKFQW

SEQ ID NO: 9677 - protein, 23 aa, Artificial Sequence
  Computer-generated peptide variant
RFKLFRKLLRLWQRKLPRHPDEA

SEQ ID NO: 9678 - protein, 43 aa, Artificial Sequence
  Computer-generated peptide variant
RLKLIKKLFKRLKNLTYTNLKLAARSGVLPHTSRFCLQLKKKR

SEQ ID NO: 9679 - protein, 44 aa, Artificial Sequence
  Computer-generated peptide variant
KLRFFQRLLRKMNRAGACNKCKGKERYLRQAKMFAACNFAILLL

SEQ ID NO: 9680 - protein, 43 aa, Artificial Sequence
  Computer-generated peptide variant
RMKMFKKIMRKIRKLMMQGLSERAAHRLPKVLRFLLCYLVKLK

SEQ ID NO: 9681 - protein, 47 aa, Artificial Sequence
  Computer-generated peptide variant
WLRLWSKFYRLLRQYQKPRKIVLLKKKRLKFVTEACAAVRLELLHAD

SEQ ID NO: 9682 - protein, 45 aa, Artificial Sequence
  Computer-generated peptide variant
FYKYIKKFLKRWKSSMRKAYAAIRREAWKAARASKLLQLELCYGN

SEQ ID NO: 9683 - protein, 44 aa, Artificial Sequence
  Computer-generated peptide variant
RYRWLNKLYRRYPCEKLKKFALAKRRAARACLKHTKLAGIRPLS

SEQ ID NO: 9684 - protein, 24 aa, Artificial Sequence
  Computer-generated peptide variant
FIRLLRKFFKRIRTAKLDNRAATD

SEQ ID NO: 9685 - protein, 82 aa, Artificial Sequence
  Computer-generated peptide variant
IMRFWKKFWKWFKKYIATLCKATALRKGALKPAPLELLCRLRGSKLGVLRRKIFGLEPLLYVLLLPLKQKLPKARVQCTKLR

SEQ ID NO: 9686 - protein, 60 aa, Artificial Sequence
  Computer-generated peptide variant
KMKLMKKYYRRLRCYLEAIMRKLLNKNMTKNPWRKKLALHAEINLALRALYLLLIRAAKR

SEQ ID NO: 9687 - protein, 71 aa, Artificial Sequence
  Computer-generated peptide variant
RLKLYKKLLRRMRKVARHLELIYPMGHLFRLLSTREAVPKANKCLLKGNEKMVAGTAACKFKCCKTKRLKA

SEQ ID NO: 9688 - protein, 25 aa, Artificial Sequence
  Computer-generated peptide variant
LFKMLRRFLRRLHTKAMDGKRIACA

SEQ ID NO: 9689 - protein, 21 aa, Artificial Sequence
  Computer-generated peptide variant
RLKLLQKLLKFMQQIRRMRRA

SEQ ID NO: 9690 - protein, 43 aa, Artificial Sequence
  Computer-generated peptide variant
YIKLFKKYLKFLKSTRLRMTLPLLALAAYDLDHTRWWRFHKRR

SEQ ID NO: 9691 - protein, 56 aa, Artificial Sequence
  Computer-generated peptide variant
RLRLMSKWMRRWRKTAGRAAKARRAYTKLKRKAASAAMKADRHLDKPMKLRHTPHH

SEQ ID NO: 9692 - protein, 25 aa, Artificial Sequence
  Computer-generated peptide variant
FLRYFRKMFRLLKQARNLRSMKLAS

SEQ ID NO: 9693 - protein, 30 aa, Artificial Sequence
  Computer-generated peptide variant
KWKYLPRLLKFFKRAKALLAAPFDRDIKRM

SEQ ID NO: 9694 - protein, 47 aa, Artificial Sequence
  Computer-generated peptide variant
KLKWYRRLLRYLNRKKSNSFVMKRAAGERRRKRVHLALHCNSGLAVW

SEQ ID NO: 9695 - protein, 41 aa, Artificial Sequence
  Computer-generated peptide variant
MIKLMNRLLRRMRQKQGLLRKLRMLWSKRAHLVKKAALPSL

SEQ ID NO: 9696 - protein, 25 aa, Artificial Sequence
  Computer-generated peptide variant
RWRLMRRYLRFLKKFVYAASKALRL

SEQ ID NO: 9697 - protein, 37 aa, Artificial Sequence
  Computer-generated peptide variant
LMRMLPKFFKLLTPQAKLAKKKKLMLRRMKIKACSIY

SEQ ID NO: 9698 - protein, 21 aa, Artificial Sequence
  Computer-generated peptide variant
KLKWLNKMIRRLKSSETLLGL

SEQ ID NO: 9699 - protein, 33 aa, Artificial Sequence
  Computer-generated peptide variant
FMKLFKKLIKRLCRGKENRAVALRCLLLVADWL

SEQ ID NO: 9700 - protein, 73 aa, Artificial Sequence
  Computer-generated peptide variant
LFKIMKRYIKWLRTAMRLKLWGLADILKISLGMMLAAKYAKHRNMHFAAHKVRYAGRKAGRRQANARERRAAH

SEQ ID NO: 9701 - protein, 30 aa, Artificial Sequence
  Computer-generated peptide variant
FLKMLRKFMKRMCSLLKMFVLARKLPKALR

SEQ ID NO: 9702 - protein, 40 aa, Artificial Sequence
  Computer-generated peptide variant
KLRLLCKILRRLKRAKLVGVKAGLEVKKKVIGLLAAWKVP

SEQ ID NO: 9703 - protein, 51 aa, Artificial Sequence
  Computer-generated peptide variant
LLRWLKRYLKYWNKKRRLPKAALPAKWMTRYAAMRAKLAPMMLLRLTCITS

SEQ ID NO: 9704 - protein, 59 aa, Artificial Sequence
  Computer-generated peptide variant
RYRFLCRLIRLFTCANKAYACKDASRRLACRLKQKCDATAKAAYDWAHNRRAALKYLLH

SEQ ID NO: 9705 - protein, 53 aa, Artificial Sequence
  Computer-generated peptide variant
KLRLFPRLYRKICQKVWLLRFPARCHYKRLMLNSFMMSRRWRWLGKLALKKLL

SEQ ID NO: 9706 - protein, 92 aa, Artificial Sequence
  Computer-generated peptide variant
FFKLLKKWLRLFRKKGIHRDFARCAKYKKEKSRMEARSALRADMRAVVDNCHKKNKCKRLRGGILRKRFHSANAKLLWLLKARRCWCADWRA

SEQ ID NO: 9707 - protein, 34 aa, Artificial Sequence
  Computer-generated peptide variant
FIKMLTRFFRRLHKRLRCAALRLWKHKCYLKIAA

SEQ ID NO: 9708 - protein, 46 aa, Artificial Sequence
  Computer-generated peptide variant
YFRFFRKMFKFLQPGDIRFLLRDCAAADILQRLDRKLRKKWLLKAL

SEQ ID NO: 9709 - protein, 34 aa, Artificial Sequence
  Computer-generated peptide variant
RLKWICRLLRLWKKIILKYGLKELSDCKRLAMYW

SEQ ID NO: 9710 - protein, 73 aa, Artificial Sequence
  Computer-generated peptide variant
LFKLMRRMLRRLKRAIKRARLKKWNIRRLKRNLSKDKQPLKMLADIKWRDFMGFWLLAKLTKRLLASLGNTPR

SEQ ID NO: 9711 - protein, 47 aa, Artificial Sequence
  Computer-generated peptide variant
RFRLLRRLMKKLRREYFFRAFCKILLVKDLKKGTTKLMAQMAANASR

SEQ ID NO: 9712 - protein, 66 aa, Artificial Sequence
  Computer-generated peptide variant
KFKLFKRLMRKLNHKLLLFTKLALIKLKEVKDFHKRIRFLRDTMRKRAKHNELFHAYGQAVALKAS

SEQ ID NO: 9713 - protein, 51 aa, Artificial Sequence
  Computer-generated peptide variant
RLKFLNRLFKYLKRWDRVRRLRDIGKARKVMAMLAACLLRKLERQDLNKAT

SEQ ID NO: 9714 - protein, 50 aa, Artificial Sequence
  Computer-generated peptide variant
KWKYFNRLMKFWKTAPLFRDVGRRALARAKMDDSAPLARSLARKKLEIIK

SEQ ID NO: 9715 - protein, 64 aa, Artificial Sequence
  Computer-generated peptide variant
KLRYFRKFLKIMRHNKLFWAILTLHRKARWLLNQVLLYKLDKKHAQKTLMKRACLLAKLHHRAL

SEQ ID NO: 9716 - protein, 42 aa, Artificial Sequence
  Computer-generated peptide variant
MMKLYKKLFRLLKKLEQWKLDPAKEDLRLLMNLVLRYIQLPA

SEQ ID NO: 9717 - protein, 34 aa, Artificial Sequence
  Computer-generated peptide variant
RFRLLKRFIKRLRNVMPLVTSRLDALFDLCQLLK

SEQ ID NO: 9718 - protein, 32 aa, Artificial Sequence
  Computer-generated peptide variant
LLRIYRKLMKWWRRECFLRKLLKLLLCHYTKI

SEQ ID NO: 9719 - protein, 20 aa, Artificial Sequence
  Computer-generated peptide variant
KFRLLTRLWRLFTSKQRRYL

SEQ ID NO: 9720 - protein, 41 aa, Artificial Sequence
  Computer-generated peptide variant
RMRWLSKFLKKYCKAWIARCGARLALWKLALKPSPDARNLN

SEQ ID NO: 9721 - protein, 76 aa, Artificial Sequence
  Computer-generated peptide variant
KYKMLKKLYRLLCSHNDKYEKGIPKPCLQLDLLRQKRDYAKKHLQARTKPLAVAANASPLHRAKARRYLFLARALM

SEQ ID NO: 9722 - protein, 29 aa, Artificial Sequence
  Computer-generated peptide variant
KWKILKRLYRWLKKAKSYAAKFGVLSQSV

SEQ ID NO: 9723 - protein, 32 aa, Artificial Sequence
  Computer-generated peptide variant
KFKYYHRLLRLICKRKQMKALATLKKISLGKE

SEQ ID NO: 9724 - protein, 26 aa, Artificial Sequence
  Computer-generated peptide variant
KWKIIRKMIRLLSRDPALLCRCARAA

SEQ ID NO: 9725 - protein, 25 aa, Artificial Sequence
  Computer-generated peptide variant
RFRLYRRWIKRLQRDAHLKYNMLYL

SEQ ID NO: 9726 - protein, 52 aa, Artificial Sequence
  Computer-generated peptide variant
IMRLFKRFFRFWRRPPKLRKQMYLIKDAGCDKAATLLAYLHLRRKGAFFRLA

SEQ ID NO: 9727 - protein, 47 aa, Artificial Sequence
  Computer-generated peptide variant
LFRMYRKLIRRYPKEKNLLRKRYGCSKAARDPSYAALLLARLFTYRC

SEQ ID NO: 9728 - protein, 72 aa, Artificial Sequence
  Computer-generated peptide variant
LFKLWRKILRYLKRDALHRCRRRCYHLTLKRRARPWKLCKHVLMVWLNWLLRQLKLGNLARKHHARLTEVQK

SEQ ID NO: 9729 - protein, 34 aa, Artificial Sequence
  Computer-generated peptide variant
MFRFFKKLLKKWQKLPVRRRRLDAFLGAPGLEWA

SEQ ID NO: 9730 - protein, 41 aa, Artificial Sequence
  Computer-generated peptide variant
FFRLIPRLIRFWRNKLFRACLRLNRKNRGAIRTAMGKAQLR

SEQ ID NO: 9731 - protein, 38 aa, Artificial Sequence
  Computer-generated peptide variant
KLKYFQKYLRLIRCASARGWKQEIAKSLRRHCKAHRLF

SEQ ID NO: 9732 - protein, 49 aa, Artificial Sequence
  Computer-generated peptide variant
RLRMLHKFLRMFNKRKPKLKDVVKCRKWAHAACCAMDFAKNKKLQAGLR

SEQ ID NO: 9733 - protein, 59 aa, Artificial Sequence
  Computer-generated peptide variant
KFKLLRKIIRKWRTLARKRNLWKKAKLCKKYMQKHILRMCTAHAYALQARHMMKSAIWL

SEQ ID NO: 9734 - protein, 27 aa, Artificial Sequence
  Computer-generated peptide variant
RFKILRRIFRLWPKVLALQRARRMGFA

SEQ ID NO: 9735 - protein, 59 aa, Artificial Sequence
  Computer-generated peptide variant
RFKLIQKIFRKIRHLPKAKFKEKHHLLKLKVKPSIRAVWPMLASWSLDRKAAKARLAKS

SEQ ID NO: 9736 - protein, 54 aa, Artificial Sequence
  Computer-generated peptide variant
RLKIMKRFFRKWRRLGRLLRQELLRINKALKFAKWWCYKAGCWLYSLAKARPLS

SEQ ID NO: 9737 - protein, 90 aa, Artificial Sequence
  Computer-generated peptide variant
LWKLWRRFLKKMKCDLRRAVLVKHCNKERKAKRKKYQLQFRLFKQRFHSAHLRAKEFTLVALANSATRRKGVKAAVLNNRAHDARNNHKM

SEQ ID NO: 9738 - protein, 79 aa, Artificial Sequence
  Computer-generated peptide variant
LLRLYPRLIRFWRKLHLPDCAKRAYRVNAANHLKAYLYLTYKTRALAMKRDKNAAAKCSKKLWALMKLTLDTHNTSRCA

SEQ ID NO: 9739 - protein, 76 aa, Artificial Sequence
  Computer-generated peptide variant
FWKIIRRYLRKLKNSLQVLGLRAKSLSAFSCRRMKTAFKTKKLELYDAQLARAINGDLLARHRVVGPLLRRMLAFL

SEQ ID NO: 9740 - protein, 45 aa, Artificial Sequence
  Computer-generated peptide variant
RMRYLRRLLRLFKTLGLKAEDLVRRDQSRRVKKAFAAKGAAKKIL

SEQ ID NO: 9741 - protein, 80 aa, Artificial Sequence
  Computer-generated peptide variant
FIRYLKRYLKKYKRRLPLYKARRYKNRLRCWRKACFQPIKKAALWYGAKAAHSTIPAREVKAQHKQFKRMALMRRDMALC

SEQ ID NO: 9742 - protein, 44 aa, Artificial Sequence
  Computer-generated peptide variant
RMKLLQRFWRLFSRRNKKNALLIRRMLLQAYHRLWLKRKQALVM

SEQ ID NO: 9743 - protein, 31 aa, Artificial Sequence
  Computer-generated peptide variant
KMKMLKRYWRRLRHQKQAGAAPACRARYEPA

SEQ ID NO: 9744 - protein, 30 aa, Artificial Sequence
  Computer-generated peptide variant
MLKIWRRLLKFWTKLLHWRMRFALRGKNTA

SEQ ID NO: 9745 - protein, 45 aa, Artificial Sequence
  Computer-generated peptide variant
RLRWIRRLLRWLRRSKKNAVCKLVMKRLVFTHAWNTLHVCLAFLA

SEQ ID NO: 9746 - protein, 44 aa, Artificial Sequence
  Computer-generated peptide variant
FFKLYRRIFKRIRKKVARMVIRLPRQALTTLALLSAANGKRKVP

SEQ ID NO: 9747 - protein, 25 aa, Artificial Sequence
  Computer-generated peptide variant
FYRLMRRMLKRYRKLLPRFPHALVG

SEQ ID NO: 9748 - protein, 42 aa, Artificial Sequence
  Computer-generated peptide variant
RMKLLNKLMRKLKKRADLLQLMKFAKPLAGSKWTAKLKFACY

SEQ ID NO: 9749 - protein, 79 aa, Artificial Sequence
  Computer-generated peptide variant
YIKLLHKILKLLRKNLHRMVKAAHMRQYKCKNTPLKLYLRNCASPKWLSRRAIFQLKKGMAKPRRKALKERYKWMGAKV

SEQ ID NO: 9750 - protein, 44 aa, Artificial Sequence
  Computer-generated peptide variant
RMRMISRLFKKLRPAKKRKKRATDAPLPLPAMRIEKIACALAQF

SEQ ID NO: 9751 - protein, 35 aa, Artificial Sequence
  Computer-generated peptide variant
KIKLIKKFWKFLRKLGEPAAWRLWKAKCLFRWSAA

SEQ ID NO: 9752 - protein, 40 aa, Artificial Sequence
  Computer-generated peptide variant
RLRIYCRLLKKLRKNACIIQLALNAGIACNKKYKLLFCLA

SEQ ID NO: 9753 - protein, 43 aa, Artificial Sequence
  Computer-generated peptide variant
YIKLLRKFMRFLKRKLAPAKPNYALTSAYSAVYPSLQLQAKKK

SEQ ID NO: 9754 - protein, 84 aa, Artificial Sequence
  Computer-generated peptide variant
KIKYYKKFLRLIKKKKKKRMRRIMCHENAASLWLTKLKIMKEANLRLLSLKELSKFFHNAFPFRKRLVFLRSAKDKLDIARALM

SEQ ID NO: 9755 - protein, 84 aa, Artificial Sequence
  Computer-generated peptide variant
RWKMLCKLYRFLRCKADFCRHRMGKRFPLGKNMTGKRDMRGLIAPLAKQKRKLLKKAERTRYLLLIPRKPQRTLADMIALKKNA

SEQ ID NO: 9756 - protein, 34 aa, Artificial Sequence
  Computer-generated peptide variant
KMRFLRRFLKKLRQLVCKLARASGKQLAQCRVAL

SEQ ID NO: 9757 - protein, 20 aa, Artificial Sequence
  Computer-generated peptide variant
RMRILRKLLRRWKSFPANLF

SEQ ID NO: 9758 - protein, 63 aa, Artificial Sequence
  Computer-generated peptide variant
KFRFLKKILRKWKTWKRIMLADKKRGKKSVYWLKCLPTMMRALMHTKLYWNFLLCALFALAKA

SEQ ID NO: 9759 - protein, 50 aa, Artificial Sequence
  Computer-generated peptide variant
WLKMFKKIMKRFKRRDANKYKILLRSARCIEKWLLAAKTKKLLSIAFPMT

SEQ ID NO: 9760 - protein, 59 aa, Artificial Sequence
  Computer-generated peptide variant
KLRLLKKFFKFMSRKAMKKHGLCVGAEWVEHLYIIWRAASAKLAVARVRVRAMKRNRLA

SEQ ID NO: 9761 - protein, 92 aa, Artificial Sequence
  Computer-generated peptide variant
KFKWWKKLLRRWRHLRKETAPAQRAKKHGCLCSKCLKPIFKLRTKKHGANALAMRAFNLLKKQHHDATNKQHAHAFRLRALNRAWDAKYANL

SEQ ID NO: 9762 - protein, 57 aa, Artificial Sequence
  Computer-generated peptide variant
RLRILKKLFKRLNPWKLMKNLLQLRKREIQPQKWLALIKKKAPNAQNCLLGKVIAVT

SEQ ID NO: 9763 - protein, 54 aa, Artificial Sequence
  Computer-generated peptide variant
RLRLIKKFYKRFKKKAKGMTAKSRAEKCTDLFKALALKNAFKHCHEYACATDAP

SEQ ID NO: 9764 - protein, 79 aa, Artificial Sequence
  Computer-generated peptide variant
RYKLYCRLFRKLKRRSLLAKSKAPNKPWSHKIAAKVFMRHLMWSHRPKILDAWTAGAELGAHRAAMNAIRRALEADLAR

SEQ ID NO: 9765 - protein, 23 aa, Artificial Sequence
  Computer-generated peptide variant
LIRYLRKLYKKIKKPAEAAWGKY

SEQ ID NO: 9766 - protein, 21 aa, Artificial Sequence
  Computer-generated peptide variant
RLRMMHKLFKRLRRLPAFALY

SEQ ID NO: 9767 - protein, 56 aa, Artificial Sequence
  Computer-generated peptide variant
FMKLMNKFLKKFTKLRKRAKCKRKRRYRDACSKVVHATAKLHSLWAFKCWDLLAMG

SEQ ID NO: 9768 - protein, 30 aa, Artificial Sequence
  Computer-generated peptide variant
KLRFIKKLLKYFSRKALHRSNCHLKAATLA

SEQ ID NO: 9769 - protein, 45 aa, Artificial Sequence
  Computer-generated peptide variant
RWRLWKRMLRLWRKAAKSGKFYSHKAAARTTKYHSLGDLRKDLLW

SEQ ID NO: 9770 - protein, 50 aa, Artificial Sequence
  Computer-generated peptide variant
LFKLMKKWFKRFRNLPRFLKLAQAALASWERDLNLYSLWAYRWRKDKMKC

SEQ ID NO: 9771 - protein, 23 aa, Artificial Sequence
  Computer-generated peptide variant
LIKFWRKLLRRYRKMMAGLRWTL

SEQ ID NO: 9772 - protein, 47 aa, Artificial Sequence
  Computer-generated peptide variant
KMRLYTRLMKFWKQRKYSLRMMRKKACRACALAAIKDPAAPRGPKTY

SEQ ID NO: 9773 - protein, 50 aa, Artificial Sequence
  Computer-generated peptide variant
KIKMYRKILKLFTSRSKPFRMLKKHDLAMIQKDKYALTCREAKLFRLLLL

SEQ ID NO: 9774 - protein, 36 aa, Artificial Sequence
  Computer-generated peptide variant
LFKLMRRLLRRYPKAIQPKRAFRGKSLQGLLELIVQ

SEQ ID NO: 9775 - protein, 58 aa, Artificial Sequence
  Computer-generated peptide variant
RLRFFKRYLRRMRNKRLALAAMGSGWAKWEGPKANAPWARRDWAREARLVLILLRKPM

SEQ ID NO: 9776 - protein, 44 aa, Artificial Sequence
  Computer-generated peptide variant
LFRLLRRWLKRYKRRKALQLKSVLLAKRTDAKMGAARNKRRAQY

SEQ ID NO: 9777 - protein, 49 aa, Artificial Sequence
  Computer-generated peptide variant
FIRLFPRLFRRLKTLKQAWMCGLLLEIRQALFRLNAKRACGEARLKASR

SEQ ID NO: 9778 - protein, 35 aa, Artificial Sequence
  Computer-generated peptide variant
RIRFLRRMLRMLKTYLHAEELAKHILNARILLLNR

SEQ ID NO: 9779 - protein, 30 aa, Artificial Sequence
  Computer-generated peptide variant
LWKLFKRLLRRLKSRLRKLNTHKHAAGSHM

SEQ ID NO: 9780 - protein, 34 aa, Artificial Sequence
  Computer-generated peptide variant
KIKLFRRYWRRFKKACANRFAYYKLARALNILYF

SEQ ID NO: 9781 - protein, 83 aa, Artificial Sequence
  Computer-generated peptide variant
LFRLLKKLWRRFRSLFDRAKCKKFVNRRRKPFLKRLQMVEWHKKPLSKLANIRITSWYVLFLLELMNREKLHRAKRKEAAATC

SEQ ID NO: 9782 - protein, 94 aa, Artificial Sequence
  Computer-generated peptide variant
KWRLFKKFFRKLRKHRLPKYAAYMLRRFDMLVWRQKKKSDPKRRALLDKTKAPPKKAGSRPRLPRLGVACLLRWGKYLHEDAALEDMPNYRREA

SEQ ID NO: 9783 - protein, 20 aa, Artificial Sequence
  Computer-generated peptide variant
KIRILRRFLKLFRSLKAHHE

SEQ ID NO: 9784 - protein, 52 aa, Artificial Sequence
  Computer-generated peptide variant
KLKFLKKFLKKWPRELKVPIKRGCLRRWLRCLLTAKPERIKTAVGRNHLLWF

SEQ ID NO: 9785 - protein, 40 aa, Artificial Sequence
  Computer-generated peptide variant
KWKMLPRLLKRFRHANAAERLSLPEAHKRKKFERWSRFAM

SEQ ID NO: 9786 - protein, 36 aa, Artificial Sequence
  Computer-generated peptide variant
YIKLWCKLLRFYPKKLYSHCLKAKFRLLPAAHRIHL

SEQ ID NO: 9787 - protein, 78 aa, Artificial Sequence
  Computer-generated peptide variant
KFKFWTKYIKKLHNKMPRKRLAFALGPNYAALRATKKAAVAVLKYERALSIRVAKLYAMHDYERAADFIRQSLKFRLL

SEQ ID NO: 9788 - protein, 56 aa, Artificial Sequence
  Computer-generated peptide variant
LMRLWNKFYRKLRRALAPLKIHRKAKLIRLQLKRAQVRLIRRMPDQLEPHAGYHFW

SEQ ID NO: 9789 - protein, 56 aa, Artificial Sequence
  Computer-generated peptide variant
KFRLLSRFMRKLRRTFDFNHAKARTRALSRWKYMFLWAEAFKKTTALKQEAERGLA

SEQ ID NO: 9790 - protein, 73 aa, Artificial Sequence
  Computer-generated peptide variant
RWKWWRRYMKLYRKLGIWKWLDLARKVHACAQYRLKHRALVPRAAAKKKHGKRRILARALRALLKLLPSAHAQ

SEQ ID NO: 9791 - protein, 45 aa, Artificial Sequence
  Computer-generated peptide variant
RFKFIKRMLRLLHRVMLRLELAKIIRPRQNVTCPKLFRRQNAARL

SEQ ID NO: 9792 - protein, 61 aa, Artificial Sequence
  Computer-generated peptide variant
KYRYIRRMLKRLHRMADFWGLKSCLKKWAQLKAQLIKDALAWRSKPMACWRKPLKKLANID

SEQ ID NO: 9793 - protein, 37 aa, Artificial Sequence
  Computer-generated peptide variant
YLKILKKYIRLIKKLTKKIPPLKAKLFARTDWACPRQ

SEQ ID NO: 9794 - protein, 85 aa, Artificial Sequence
  Computer-generated peptide variant
RFKYLRKYFKKLPQAKARLTRAKEAQQLMKYIARIRIKGLPNYRWNKLRPDCRRYATYWMTAQPARDAARTRPAQSKRNAALLKL

SEQ ID NO: 9795 - protein, 21 aa, Artificial Sequence
  Computer-generated peptide variant
KLRLFKKWLKKLKKAYQLASA

SEQ ID NO: 9796 - protein, 27 aa, Artificial Sequence
  Computer-generated peptide variant
RMRLMCKWLKKWKNAIYLRRKMYGLLA

SEQ ID NO: 9797 - protein, 25 aa, Artificial Sequence
  Computer-generated peptide variant
RYKIFHRWLRRLKPGAADKRAICAP

SEQ ID NO: 9798 - protein, 21 aa, Artificial Sequence
  Computer-generated peptide variant
YYKYIKKFLRLLKCTKNPRLA

SEQ ID NO: 9799 - protein, 34 aa, Artificial Sequence
  Computer-generated peptide variant
FFRMMKKWFKLLHTALLSKAKQNKRARLRAQHTP

SEQ ID NO: 9800 - protein, 50 aa, Artificial Sequence
  Computer-generated peptide variant
RIRLLRRWLRKFRTHQDRLRYTKIRYRLQVRKLKFKLAAFAMTGILWPEL

SEQ ID NO: 9801 - protein, 79 aa, Artificial Sequence
  Computer-generated peptide variant
RIRLLQKYWRRYRHAPLLGKIGFIAAKLKERKITEAHLLKAKYLRKLLGTWVLAARNFVFRKVLEINLRLFVAAIIYAK

SEQ ID NO: 9802 - protein, 41 aa, Artificial Sequence
  Computer-generated peptide variant
KLRMMRRMLRYYHQHKRARAQAAAKTIARQCEPMYAAKLKH

SEQ ID NO: 9803 - protein, 25 aa, Artificial Sequence
  Computer-generated peptide variant
LYKLLNKMWKILKRAEWVICKVKLK

SEQ ID NO: 9804 - protein, 45 aa, Artificial Sequence
  Computer-generated peptide variant
RLKFWRRLWKMLPHIKEKSMKGLKRELLASLKPIAYADPAKLKRW

SEQ ID NO: 9805 - protein, 71 aa, Artificial Sequence
  Computer-generated peptide variant
MIRLLRKMWRKYRPLRLKKHYANFANMWYKCLHPPSGRCLAEPKLDELLLRKPLLARRWLRKRLKCCCKHL

SEQ ID NO: 9806 - protein, 47 aa, Artificial Sequence
  Computer-generated peptide variant
LFRLWKKLLRFFKRTRKTSAATTWKLHKLRRHAGAQKNELEQLHCKW

SEQ ID NO: 9807 - protein, 52 aa, Artificial Sequence
  Computer-generated peptide variant
KIRLIKRMMKRMQKDTDKGRSAALALVLGRPRTVLKLVAAKEWIARAHNAGK

SEQ ID NO: 9808 - protein, 69 aa, Artificial Sequence
  Computer-generated peptide variant
LLRIMRKWYKYMKNRLCQCAKAMRLLATLRSVWEFSSKNAALRLYHLALPKAKLDKSRRLWDNTEQKAK

SEQ ID NO: 9809 - protein, 29 aa, Artificial Sequence
  Computer-generated peptide variant
LWKFLRKLLKRLNRKKAATFKKFACACDK

SEQ ID NO: 9810 - protein, 46 aa, Artificial Sequence
  Computer-generated peptide variant
FLKFIKKYIRKLKHHRFLSLKADIEKLARFALIELKIRRKTKTAAG

SEQ ID NO: 9811 - protein, 27 aa, Artificial Sequence
  Computer-generated peptide variant
LIRLFKKILRRMHKAKERAKFKLDLLI

SEQ ID NO: 9812 - protein, 24 aa, Artificial Sequence
  Computer-generated peptide variant
KLRLLKKFLKFLRKALEALPRRLF

SEQ ID NO: 9813 - protein, 56 aa, Artificial Sequence
  Computer-generated peptide variant
RLKLWCRFIKILTRAAKAGHIDLTRLLLELASKAKCKQLQRLLWHKLYCDYIYATK

SEQ ID NO: 9814 - protein, 81 aa, Artificial Sequence
  Computer-generated peptide variant
RFKYFRKWLRRLRKANEAPHKFKHCAMPALAHLRLMRSKGGLNEACLRKKYKRALGKHVAYQKVKKRNLARSQQLIPYKYR

SEQ ID NO: 9815 - protein, 31 aa, Artificial Sequence
  Computer-generated peptide variant
RFRFWRKLLRKINRCNSAKGKAALHAAVHLR

SEQ ID NO: 9816 - protein, 78 aa, Artificial Sequence
  Computer-generated peptide variant
RLRLWQKIFRRYTHVMWDRAPLFRNAAAVLKYARWKTQMLLALKKMAHKRRAYKPTRCNARWLQALERLLARREAQHS

SEQ ID NO: 9817 - protein, 39 aa, Artificial Sequence
  Computer-generated peptide variant
RLKLIRRLWKLLRRIGMALAKAALLFLWLHRVPGHKYKR

SEQ ID NO: 9818 - protein, 61 aa, Artificial Sequence
  Computer-generated peptide variant
RLKLWRRMLRRLNCKEEARKKLLRWRLYMCGRRAPKIIMNYCWAAQGLVLNVKACKKQLLT

SEQ ID NO: 9819 - protein, 21 aa, Artificial Sequence
  Computer-generated peptide variant
RMKFLKRFFKLLHKACRVADP

SEQ ID NO: 9820 - protein, 73 aa, Artificial Sequence
  Computer-generated peptide variant
RMKMYQKLLRKLPKWLRYKRWWLLAKKRRINNRQLVNRMKKANLNLADYAYRRWLYAWSRNWLVRIRMLMRLK

SEQ ID NO: 9821 - protein, 23 aa, Artificial Sequence
  Computer-generated peptide variant
LYKYYTRLLRLLKCLRQHHRGIA

SEQ ID NO: 9822 - protein, 47 aa, Artificial Sequence
  Computer-generated peptide variant
MMKWYRRLLRRFRKAIAWPTRERRAVLIWKLQARTLQKAAVRRGVGL

SEQ ID NO: 9823 - protein, 79 aa, Artificial Sequence
  Computer-generated peptide variant
ILKFLQRILRKMRSGHWHREKADGWKHDMFALAEARIATSVQLRAAKRRRIIHLLRLRVKYLGFFALWANYKKRRALRA

SEQ ID NO: 9824 - protein, 74 aa, Artificial Sequence
  Computer-generated peptide variant
LYRLLSKYIRFYRKALRPESRCNAPRLRIRALTKCLADMEFNRARDLAIKKYWRRAPAAQPRTDYEKEAKRLTR

SEQ ID NO: 9825 - protein, 89 aa, Artificial Sequence
  Computer-generated peptide variant
RMRILRRIMKMMRKTEWSKLGLICADRLEQKLAALYLYCPLRALGGGRLAWALAYRAGLRARMDNIMAMKKAAKDKIKEADGKHLSKLH

SEQ ID NO: 9826 - protein, 100 aa, Artificial Sequence
  Computer-generated peptide variant
KWRLLRRLLKRWKRAQKRCINGWMNAECMWHKRANVVLRAALALAFKGYLLNYCMTKRHKFHLPNRFKWVKAAALNLSHRKGKAPRKRFRLDDYRKLRYL

SEQ ID NO: 9827 - protein, 57 aa, Artificial Sequence
  Computer-generated peptide variant
LYKFLRKLLRKLNRMLALKKSLKAELLPIYNKLKGGIKRALEYELSKNPRKPKIDPW

SEQ ID NO: 9828 - protein, 71 aa, Artificial Sequence
  Computer-generated peptide variant
LYRIYKKFWKRIRKQKVLLLAAEAYAKAILLKAKAKLLKILLRKRIEKQAEKDKHAYKAELVLAEKNMLLL

SEQ ID NO: 9829 - protein, 27 aa, Artificial Sequence
  Computer-generated peptide variant
IIKWYCRYLKFIRRYLCARAKARKLLH

SEQ ID NO: 9830 - protein, 67 aa, Artificial Sequence
  Computer-generated peptide variant
RFRMLQKLIKKLSKHFSKRRMALNMWIHRDNKMCMRKAALLKAMRKFKNARAMLKSLKPKQQALPCR

SEQ ID NO: 9831 - protein, 100 aa, Artificial Sequence
  Computer-generated peptide variant
FFKILCKLFKLLKRRAPTKPYKCLLRRRAPRPHRLLHFLKKSDLSKVKWWRQAKLCARVILRCRILDHLREHKILQATYAVANKGVLKEAPLIRTRRRMR

SEQ ID NO: 9832 - protein, 53 aa, Artificial Sequence
  Computer-generated peptide variant
IFRYLRRMLRFIQNRVRLKQWIAELRNASAALWIARRRRLFYLLTLLLNHRAF

SEQ ID NO: 9833 - protein, 27 aa, Artificial Sequence
  Computer-generated peptide variant
IIKMLKKILKKIRPALLRGYRDCKALI

SEQ ID NO: 9834 - protein, 81 aa, Artificial Sequence
  Computer-generated peptide variant
RWKWLCKWYKKWRKHCGYEKAACKRLRQAHKRYALQKLNANMLLFKKDARRSALIQLFHDRLRRGKLKENNLQVVLPKYLR

SEQ ID NO: 9835 - protein, 34 aa, Artificial Sequence
  Computer-generated peptide variant
KYKLLRRMFKLITTKAAWNGLEFARRKAQPFKIK

SEQ ID NO: 9836 - protein, 57 aa, Artificial Sequence
  Computer-generated peptide variant
KYRLLHRLLKWWCKILTKVELLRLCFDIAYLRLMYSGLPCRRMKKARAPKMRQARIL

SEQ ID NO: 9837 - protein, 50 aa, Artificial Sequence
  Computer-generated peptide variant
IFKLLNRFMKLIRRANACKFRMRAKAPLKTTYCWRLGLRVRRAAAALLKK

SEQ ID NO: 9838 - protein, 29 aa, Artificial Sequence
  Computer-generated peptide variant
LIKIFRRFMKYLTHRAIEARFKAAASGRK

SEQ ID NO: 9839 - protein, 60 aa, Artificial Sequence
  Computer-generated peptide variant
KLKFMKRWFKKLSKECMSMVRDAMIFAWIKALEGRKAPKRRLHLCARMLWEKLKALARQL

SEQ ID NO: 9840 - protein, 30 aa, Artificial Sequence
  Computer-generated peptide variant
WLKLMRKMWRRFRHCRAHDKLLKYASWLKQ

SEQ ID NO: 9841 - protein, 22 aa, Artificial Sequence
  Computer-generated peptide variant
LLRFFKKFLKLYRHMAKDKGHA

SEQ ID NO: 9842 - protein, 60 aa, Artificial Sequence
  Computer-generated peptide variant
KIKILRRLMKRLPKAKWKFYMEANKAAKKKRKRWCFRILCRLPPTALALVKASMQYVANQ

SEQ ID NO: 9843 - protein, 34 aa, Artificial Sequence
  Computer-generated peptide variant
MFKMLKRILRFFKSLSAAYCRALALFKVCRSRAK

SEQ ID NO: 9844 - protein, 32 aa, Artificial Sequence
  Computer-generated peptide variant
KLRLLRRLYKRMKQAGITWLVKCSLHRLEIAN

SEQ ID NO: 9845 - protein, 25 aa, Artificial Sequence
  Computer-generated peptide variant
YFRWWRRLYRRWQTKERLLLALEAR

SEQ ID NO: 9846 - protein, 42 aa, Artificial Sequence
  Computer-generated peptide variant
WWKMLTRYFRRFRKAKARSFLLHALVLEWLLFRMKKICALRP

SEQ ID NO: 9847 - protein, 41 aa, Artificial Sequence
  Computer-generated peptide variant
LFRFLHKYLKKFRKKAGLRNARGAARCDFHKDRRHHAAHAL

SEQ ID NO: 9848 - protein, 58 aa, Artificial Sequence
  Computer-generated peptide variant
RLRFFKKLLKRLPHLLSHRMLLARRCRLGLQALWRTPVMRYACKLLLMWSKYEHCKWC

SEQ ID NO: 9849 - protein, 39 aa, Artificial Sequence
  Computer-generated peptide variant
KIKFIRRLWKFLPRLRLRRRWCPKHSARAAKALCVPLLL

SEQ ID NO: 9850 - protein, 35 aa, Artificial Sequence
  Computer-generated peptide variant
RYRLFKRWYKKLNRIWGLELHAINKVRLPLRLKAH

SEQ ID NO: 9851 - protein, 53 aa, Artificial Sequence
  Computer-generated peptide variant
LWRFYRKMWKRLKRLELLWAGLHKAHINKARAVAQRCKFQHFRSARAIKHKIR

SEQ ID NO: 9852 - protein, 84 aa, Artificial Sequence
  Computer-generated peptide variant
KWRFFKRLIRFYPRLAKKAPFILATRLRTLRRRKPVHLLKPLGKAKFWWVAAAAAHMHLKCRRRLCASYKYRLELAREGEKGAR

SEQ ID NO: 9853 - protein, 37 aa, Artificial Sequence
  Computer-generated peptide variant
KWRLFRKLLRLLHKRCVRWYLIRLGAKAAYMAQLRCA

SEQ ID NO: 9854 - protein, 26 aa, Artificial Sequence
  Computer-generated peptide variant
KLKLWTRFLRRFPRYRLTARQVMNLL

SEQ ID NO: 9855 - protein, 24 aa, Artificial Sequence
  Computer-generated peptide variant
RLRWIQRYLKLLRRFRGMDSAAAI

SEQ ID NO: 9856 - protein, 61 aa, Artificial Sequence
  Computer-generated peptide variant
LFKYYRRFLRKLRPLKLGRKLKIRPLSFANKSAAESAAKTATAYRLHFDQLAAKCLKSHLQ

SEQ ID NO: 9857 - protein, 25 aa, Artificial Sequence
  Computer-generated peptide variant
KLRFWHRMLKLLKRGLLPNLRPSTR

SEQ ID NO: 9858 - protein, 34 aa, Artificial Sequence
  Computer-generated peptide variant
RFKLIPRLIRKWKRNILAFKLLDLYAHFKWFGAA

SEQ ID NO: 9859 - protein, 29 aa, Artificial Sequence
  Computer-generated peptide variant
RFRFMKRLIRKMKKSSLVLDELYLQFALA

SEQ ID NO: 9860 - protein, 51 aa, Artificial Sequence
  Computer-generated peptide variant
RIKIIPKFIKYIKKRRARGCAAAACLVLKVHDRLEMKSKLELALIRKRKAI

SEQ ID NO: 9861 - protein, 39 aa, Artificial Sequence
  Computer-generated peptide variant
FYKLLCKMLKKITTRKIALNLACKTLKDATKAAGRCFKG

SEQ ID NO: 9862 - protein, 36 aa, Artificial Sequence
  Computer-generated peptide variant
RMRLYRRFLRWLKQELHVKIQFQAYKSAMKSALAKL

SEQ ID NO: 9863 - protein, 99 aa, Artificial Sequence
  Computer-generated peptide variant
RYKLWHKLFRKIRRRRPMMKCKKPRLLYWEKKIAAMWKILMLWRYKLACQSMRRPANDLALRAKLMWCGYNKKQRCCWKYILRRKRKILHAAARQLALM

SEQ ID NO: 9864 - protein, 23 aa, Artificial Sequence
  Computer-generated peptide variant
RMKIFKKYLRLLKNILKLALRFP

SEQ ID NO: 9865 - protein, 40 aa, Artificial Sequence
  Computer-generated peptide variant
KLKFMRRLYKLFKTLKRCCAGRTERALQDAPRNLKKGYAL

SEQ ID NO: 9866 - protein, 56 aa, Artificial Sequence
  Computer-generated peptide variant
RMKFYKRMIRKFKQNPQKALLLARRELLEATQRAPWLLLGRRKRLEADNRKLLLVR

SEQ ID NO: 9867 - protein, 59 aa, Artificial Sequence
  Computer-generated peptide variant
RFRFLKRFLRKLRRHMKERMQRPAVAAWALKDLRAPLLLMKKQEPARAPHGHKQRKCIW

SEQ ID NO: 9868 - protein, 48 aa, Artificial Sequence
  Computer-generated peptide variant
LIKLIRKWLRKLKHENHLACRTKMRRALLAGAVGRNQHAKRCCKNRRN

SEQ ID NO: 9869 - protein, 35 aa, Artificial Sequence
  Computer-generated peptide variant
LFRFMHRYLKRLCRAAWEGLRNQGYRRNLTARLRK

SEQ ID NO: 9870 - protein, 75 aa, Artificial Sequence
  Computer-generated peptide variant
RLRFFHRILKFIKKCLRRWRLLLMLQQNCAAHLAWSRHYKTAKGLLRSMHSRKWPRKAKLEASQKKARAKLAALD

SEQ ID NO: 9871 - protein, 25 aa, Artificial Sequence
  Computer-generated peptide variant
FLRILHKMLKRMRTMVKRKADYLLE

SEQ ID NO: 9872 - protein, 65 aa, Artificial Sequence
  Computer-generated peptide variant
RFKLLQRIFKLMNKVAEKAGQMRFNTYGKHISAALVELLIRLKKSRGMALRRIHAVGRLRLLKAL

SEQ ID NO: 9873 - protein, 36 aa, Artificial Sequence
  Computer-generated peptide variant
KMRFLSRFMKLWNRACFLRVLRSVLRYKLLKRIGKA

SEQ ID NO: 9874 - protein, 89 aa, Artificial Sequence
  Computer-generated peptide variant
RIRFWKRFMKKINCRKFPHLRHRLLMLGLAARRRLAMPGKLKKKRGWRYIALAQKAQKMAAIMFLLVREIDLPRAVLIADRLRMLTKLH

SEQ ID NO: 9875 - protein, 20 aa, Artificial Sequence
  Computer-generated peptide variant
LLRFWTKLMRKYSKSLTARN

SEQ ID NO: 9876 - protein, 30 aa, Artificial Sequence
  Computer-generated peptide variant
KLKLIKRYMRKYKKLTRFLTHAAVARYLKS

SEQ ID NO: 9877 - protein, 32 aa, Artificial Sequence
  Computer-generated peptide variant
RFKIIKKFLKLYKKEQLIAWAFLRERENFALL

SEQ ID NO: 9878 - protein, 37 aa, Artificial Sequence
  Computer-generated peptide variant
YLKIFCRYIRRLRKGNRRALLSAKLRLKQIPRAFHQG

SEQ ID NO: 9879 - protein, 48 aa, Artificial Sequence
  Computer-generated peptide variant
LFRMFRKMIRWLKRWIIKLKWKAMLHLRKLPQYHNRRPAFFLAHKKAL

SEQ ID NO: 9880 - protein, 21 aa, Artificial Sequence
  Computer-generated peptide variant
KLRLISRYFKLLRPRLKAPYH

SEQ ID NO: 9881 - protein, 29 aa, Artificial Sequence
  Computer-generated peptide variant
MFRLLKRWYRRWRKSVPLDTRLRDWLLFL

SEQ ID NO: 9882 - protein, 32 aa, Artificial Sequence
  Computer-generated peptide variant
MWKMIKRLWRKIKKLKRKPAMAQAAWMQPLML

SEQ ID NO: 9883 - protein, 40 aa, Artificial Sequence
  Computer-generated peptide variant
YMRMLKRYLRRFKSAYLDFYKWLVPESRRRRMQAARALAR

SEQ ID NO: 9884 - protein, 23 aa, Artificial Sequence
  Computer-generated peptide variant
RYRWLHKFLRRLRRRWAARHAAF

SEQ ID NO: 9885 - protein, 61 aa, Artificial Sequence
  Computer-generated peptide variant
KLKMYHKFLRRWKTLRAVAGLHLPDRLRAKWHKARAKNRYRYEKSNADPKRPCRPFFLPRA

SEQ ID NO: 9886 - protein, 23 aa, Artificial Sequence
  Computer-generated peptide variant
KFKFYHKFLRFLRRVLKDCIAAA

SEQ ID NO: 9887 - protein, 29 aa, Artificial Sequence
  Computer-generated peptide variant
KMKIFKKWLKLLRPAGPARAKSARAHLAN

SEQ ID NO: 9888 - protein, 72 aa, Artificial Sequence
  Computer-generated peptide variant
RLKLMCRMWRKIRKRAYWFFETSRLASLKEPLFTERKWALKPLKAERWKKKSQFVTIKLWTAKMRALRMAAA

SEQ ID NO: 9889 - protein, 59 aa, Artificial Sequence
  Computer-generated peptide variant
KLRMLKRYFKRYRSAALAVAALVHKEKNKGNQTKSRHVESKAKLQAAKKLPLRDELFKS

SEQ ID NO: 9890 - protein, 20 aa, Artificial Sequence
  Computer-generated peptide variant
IMRLYKKYFRFIHRALLLKQ

SEQ ID NO: 9891 - protein, 37 aa, Artificial Sequence
  Computer-generated peptide variant
KIRFYRKLYKLLRRDHANALALKRADMRCWKHAGCLA

SEQ ID NO: 9892 - protein, 35 aa, Artificial Sequence
  Computer-generated peptide variant
RLRMFSKFIRRLQSKRDKDAAPTLSAGILKLEKRA

SEQ ID NO: 9893 - protein, 23 aa, Artificial Sequence
  Computer-generated peptide variant
RLKLINRLYKRMKNRAPSLAAGA

SEQ ID NO: 9894 - protein, 34 aa, Artificial Sequence
  Computer-generated peptide variant
IWKLIRRLYRRLRSLALEKRKKHAKLMLTWRQWY

SEQ ID NO: 9895 - protein, 47 aa, Artificial Sequence
  Computer-generated peptide variant
LLKLYRKLLRMYTNKWDLLLERLPTLPLIRKKNQLELNRVDGLAKLK

SEQ ID NO: 9896 - protein, 68 aa, Artificial Sequence
  Computer-generated peptide variant
RYKLFKRYLRFIRRGGHALVSKRRRMVAHLAEILIIRCLKLPCSWKMVDLARAALTKKEHKQALADRK

SEQ ID NO: 9897 - protein, 46 aa, Artificial Sequence
  Computer-generated peptide variant
FFRLFRKLWRRWKRAKTLPARMNRPFATLAKAMSAHKTLYLNHELL

SEQ ID NO: 9898 - protein, 40 aa, Artificial Sequence
  Computer-generated peptide variant
KLKLLNKLMKIITNAWRGLCRKRFYRILKRKLMLVYNIAK

SEQ ID NO: 9899 - protein, 38 aa, Artificial Sequence
  Computer-generated peptide variant
RLRLLRKIMKKIQHRRLEAKADKKTNKEAAASWGSRAA

SEQ ID NO: 9900 - protein, 60 aa, Artificial Sequence
  Computer-generated peptide variant
RYRWMQRFFKKLNREARAIAKHKLMVLCWYLKAKLAKVAIGIKLKAICVHKWKARLKPKW

SEQ ID NO: 9901 - protein, 23 aa, Artificial Sequence
  Computer-generated peptide variant
KLKLWTRLLKLLRRWAMDLKAVS

SEQ ID NO: 9902 - protein, 49 aa, Artificial Sequence
  Computer-generated peptide variant
WYRLFRKLFRFFCRFHNLDRVERKAALLNLLKNVRLTLAGMKARLWAKS

SEQ ID NO: 9903 - protein, 98 aa, Artificial Sequence
  Computer-generated peptide variant
FLRLLRKLFRKWQKQVALWKARDVSETYRKLLQIPMTRCKKLAICDATMEKKTYKAYLLLCLRKVLLRTGKGRKLKKAKRDVRLFTPLQKKYGLKHRL

SEQ ID NO: 9904 - protein, 64 aa, Artificial Sequence
  Computer-generated peptide variant
LFRFLRRWLRRLRKAHARRGLAKKRLACASYWLQSFDKHKCRRSSRALGGCRKAVFSPSKGQFA

SEQ ID NO: 9905 - protein, 34 aa, Artificial Sequence
  Computer-generated peptide variant
FLRLLNRFLRLLRTHGHQAAKRLKVARACSARRK

SEQ ID NO: 9906 - protein, 29 aa, Artificial Sequence
  Computer-generated peptide variant
LYRWLRRMLKKLKKVAFMIANRHAKAALG

SEQ ID NO: 9907 - protein, 34 aa, Artificial Sequence
  Computer-generated peptide variant
LFKMLRRIFKRLKSRMKAALWCWPVGARWKGSLL

SEQ ID NO: 9908 - protein, 42 aa, Artificial Sequence
  Computer-generated peptide variant
LWRMLPKIFKILRKRNLLARLVWAKHHYDYLRAKDGRAMAPL

SEQ ID NO: 9909 - protein, 34 aa, Artificial Sequence
  Computer-generated peptide variant
KFKMMRKLFKKFTRVNKLLPDAAAALAHKHRLIF

SEQ ID NO: 9910 - protein, 45 aa, Artificial Sequence
  Computer-generated peptide variant
LIKIFRKFLKKMNRAKTQARLAQDAATKAARYLARMKARRYLVYR

SEQ ID NO: 9911 - protein, 34 aa, Artificial Sequence
  Computer-generated peptide variant
FMKYFCRLFKRMKCRILAANEWYLNRLRKKILAL

SEQ ID NO: 9912 - protein, 33 aa, Artificial Sequence
  Computer-generated peptide variant
MIKLMQKMWKMWSKRAAKRRNLRHAEAARKALC

SEQ ID NO: 9913 - protein, 42 aa, Artificial Sequence
  Computer-generated peptide variant
WLRLFRRLLRFLRKYLEKRKHQAWRRQGAAKKLQWRACVYER

SEQ ID NO: 9914 - protein, 55 aa, Artificial Sequence
  Computer-generated peptide variant
RLKIMTRLIRRWCKLMAALMLYKLRKLLYAAVLLGGFAHLERPEKRRLFKIYRAT

SEQ ID NO: 9915 - protein, 23 aa, Artificial Sequence
  Computer-generated peptide variant
KLKIYPKLFKLWKSRAARMYVRL

SEQ ID NO: 9916 - protein, 56 aa, Artificial Sequence
  Computer-generated peptide variant
RIRYIKRIIRRWHRPDRFKFAKSALLILFKRKAKAFRLMAEYAVARAVRRTEMLAK

SEQ ID NO: 9917 - protein, 25 aa, Artificial Sequence
  Computer-generated peptide variant
KLKWWCRLFKKLCKLKKAPDAAHLL

SEQ ID NO: 9918 - protein, 35 aa, Artificial Sequence
  Computer-generated peptide variant
IMKFWKRLLKRYKCYLLICLLLLCKKISDFRKRLI

SEQ ID NO: 9919 - protein, 53 aa, Artificial Sequence
  Computer-generated peptide variant
RLKFWKKFLKKLKPIRLKMYALKTLLPAFLVRAKNRADDRVTMGLPVCPARTK

SEQ ID NO: 9920 - protein, 24 aa, Artificial Sequence
  Computer-generated peptide variant
LLRIWKRLLKLIQKAVCLYQERDR

SEQ ID NO: 9921 - protein, 56 aa, Artificial Sequence
  Computer-generated peptide variant
RLKLFKRMFKLYRRLKGGHVHAVWKKHIRRAKGWFERKYCSRALALQWALRLKNNE

SEQ ID NO: 9922 - protein, 24 aa, Artificial Sequence
  Computer-generated peptide variant
KLKYLKKYLKFLTKVAQDLQYAKL

SEQ ID NO: 9923 - protein, 26 aa, Artificial Sequence
  Computer-generated peptide variant
MLRLLTRLLKKFRKEHLNARLGLSCD

SEQ ID NO: 9924 - protein, 60 aa, Artificial Sequence
  Computer-generated peptide variant
LFKFYSRLYRFLKKDAMHARLAHNIWRDYPRAKIRLIKNWATAKKPLASKNRLAKTRAHR

SEQ ID NO: 9925 - protein, 33 aa, Artificial Sequence
  Computer-generated peptide variant
RLRFYQKFFRFLSRRMRLLDFLGKGLTRCLALL

SEQ ID NO: 9926 - protein, 31 aa, Artificial Sequence
  Computer-generated peptide variant
RWRYLKKLWKLLNKWPTLLACTRRKAYWKLI

SEQ ID NO: 9927 - protein, 34 aa, Artificial Sequence
  Computer-generated peptide variant
YYKILRRLWKKLRKRYVLATFMASAWKLGVMAKL

SEQ ID NO: 9928 - protein, 53 aa, Artificial Sequence
  Computer-generated peptide variant
LIRFIHKMIRYLRQARLNKKARQGKLLAKRIKLLNEASRAPLAQKLQARIWID

SEQ ID NO: 9929 - protein, 28 aa, Artificial Sequence
  Computer-generated peptide variant
LWKILRKWLRRFQRLELLGHAAAPRLKE

SEQ ID NO: 9930 - protein, 22 aa, Artificial Sequence
  Computer-generated peptide variant
KWKFLHKMLKLIRQRARSAWLR

SEQ ID NO: 9931 - protein, 28 aa, Artificial Sequence
  Computer-generated peptide variant
RIRFFRRMFKMYQTIARAVLLAARLRPK

SEQ ID NO: 9932 - protein, 22 aa, Artificial Sequence
  Computer-generated peptide variant
RLKLINRLYRKFRPPLPVLVLR

SEQ ID NO: 9933 - protein, 23 aa, Artificial Sequence
  Computer-generated peptide variant
YLKMIRRLFRLYRPLELARAKPK

SEQ ID NO: 9934 - protein, 72 aa, Artificial Sequence
  Computer-generated peptide variant
LYKYLNKWYKKMKRRAAPLAMGAALARKGYARDKVPRLNKDDLLRLCWGIRPKARWKLALHPLKAERNPALE

SEQ ID NO: 9935 - protein, 39 aa, Artificial Sequence
  Computer-generated peptide variant
FLKLFQRFFKRLSRLRSELCAKIIAAANYAGCKKAMRKL

SEQ ID NO: 9936 - protein, 79 aa, Artificial Sequence
  Computer-generated peptide variant
RLRILCRWIRRLRRYTAVIAKKKLINKLRKKIRKGHLRIDKAAYALFFRLWAGAVKDYLYTMKIIYYLYKRVLAHAVLR

SEQ ID NO: 9937 - protein, 37 aa, Artificial Sequence
  Computer-generated peptide variant
RLRLWKRYLKYYKRLRKRNADSSWPLLLLRLHKSCHK

SEQ ID NO: 9938 - protein, 21 aa, Artificial Sequence
  Computer-generated peptide variant
RYKFFNKWLKILKRRVLHMAA

SEQ ID NO: 9939 - protein, 29 aa, Artificial Sequence
  Computer-generated peptide variant
MLKLLKRWFRMFKREAKLAVFKCKNKAAE

SEQ ID NO: 9940 - protein, 38 aa, Artificial Sequence
  Computer-generated peptide variant
LLKILKKMWKKFKKAISQKAAGLLPERGAESKQDKPRI

SEQ ID NO: 9941 - protein, 32 aa, Artificial Sequence
  Computer-generated peptide variant
LMKWLRKLLRFMRTRPDTAQRAACKRLWKLAL

SEQ ID NO: 9942 - protein, 26 aa, Artificial Sequence
  Computer-generated peptide variant
LLRFYRKLMKFLRKYRALARKWKAGS

SEQ ID NO: 9943 - protein, 27 aa, Artificial Sequence
  Computer-generated peptide variant
KLRFIRKILRMYRPALTLRAIHGKRHL

SEQ ID NO: 9944 - protein, 50 aa, Artificial Sequence
  Computer-generated peptide variant
KWKLLQRFYKRMRRARFVYLKLGLDSKRSVVCADKRAKALREAELQIMRL

SEQ ID NO: 9945 - protein, 37 aa, Artificial Sequence
  Computer-generated peptide variant
RYKFFRRLMRMLKKCLGDKSDLAGLNRKVAARAQRGS

SEQ ID NO: 9946 - protein, 43 aa, Artificial Sequence
  Computer-generated peptide variant
MFKWFRRILRLIRKYKADAIAWGGRAHKVLRCRLKNAWLKERW

SEQ ID NO: 9947 - protein, 32 aa, Artificial Sequence
  Computer-generated peptide variant
MWKMFRKLIKRYKKLKNKALCNMALAAANHYY

SEQ ID NO: 9948 - protein, 78 aa, Artificial Sequence
  Computer-generated peptide variant
MWKLLQKLLRRWCKFRQGGKASDKRAAKSIRKGAQLRRACKDFKFPRRCARAKLALTVIIDYRYLAHYLVWKAHIRRT

SEQ ID NO: 9949 - protein, 49 aa, Artificial Sequence
  Computer-generated peptide variant
LYKLLQKMFKWLSHLRLTKRAELAALSKWKEVDKKGKRWIDARAHRRKC

SEQ ID NO: 9950 - protein, 68 aa, Artificial Sequence
  Computer-generated peptide variant
LMKIFQRLYKRLKRLKKPAMFAGTSAAWLQALARLQKRLKSKLHVMRNKILALRVWNRKLEHREALLM

SEQ ID NO: 9951 - protein, 21 aa, Artificial Sequence
  Computer-generated peptide variant
LLKFWRRFLRFLCKSEAAARI

SEQ ID NO: 9952 - protein, 40 aa, Artificial Sequence
  Computer-generated peptide variant
LIKMFKRFWKLLNNLLERAATCSLAKLGTKWATRLEKVYA

SEQ ID NO: 9953 - protein, 27 aa, Artificial Sequence
  Computer-generated peptide variant
KFKLFRRFFRKLKQWWLHKHARLAPWA

SEQ ID NO: 9954 - protein, 25 aa, Artificial Sequence
  Computer-generated peptide variant
RMRYLRKFYRKWQRTKDWAFALFAL

SEQ ID NO: 9955 - protein, 63 aa, Artificial Sequence
  Computer-generated peptide variant
LMRWYHRMLRKFKKAEARHMLIALLDIQAEKKKAQARVKFLCKQARLKLKQLRMLWGWRAIHD

SEQ ID NO: 9956 - protein, 65 aa, Artificial Sequence
  Computer-generated peptide variant
LIKFMCKYLRYLSKARVLDKHRWKASAARGCRLTKRARFIFANVCARKIFGIIKRKLKAAAKLKP

SEQ ID NO: 9957 - protein, 24 aa, Artificial Sequence
  Computer-generated peptide variant
LWRLLRRLIRLYKRAAISRRAKLH

SEQ ID NO: 9958 - protein, 31 aa, Artificial Sequence
  Computer-generated peptide variant
MYKLLRRYFKRLSKLAVYKLCCILKLARLWH

SEQ ID NO: 9959 - protein, 59 aa, Artificial Sequence
  Computer-generated peptide variant
KFKFLKRMLKFWKTKPKAYTATEQPLGLKIGVLRLQKKKLPALLRIAVARSKRRLVGCK

SEQ ID NO: 9960 - protein, 71 aa, Artificial Sequence
  Computer-generated peptide variant
RFRMLPRWLKFFSKWRWLLKKEAKILRRILADRCWQRNEKKLKRPWWATALYAAAFHALRRRSDEHKIALV

SEQ ID NO: 9961 - protein, 28 aa, Artificial Sequence
  Computer-generated peptide variant
LWRLWKKMIKKFRRHLAAYMRQYGKADL

SEQ ID NO: 9962 - protein, 39 aa, Artificial Sequence
  Computer-generated peptide variant
LWRFMRRYYRRMQQLLLAVMKYLRIQQKKAARRLIWKVA

SEQ ID NO: 9963 - protein, 70 aa, Artificial Sequence
  Computer-generated peptide variant
KFKFMKRLIKFFKKLNRRRHKRNMRKKNNCHAALLCGAECDRALLFKGWNAKNCIKRRLAAEWALHAAVV

SEQ ID NO: 9964 - protein, 43 aa, Artificial Sequence
  Computer-generated peptide variant
KIKYLCKMFKLFKTKAKLRFKAADPAEKKLRSFHCASSRRTLW

SEQ ID NO: 9965 - protein, 88 aa, Artificial Sequence
  Computer-generated peptide variant
LLRFFNRFLRIFRRLRATKARKSKTVYKLFKLCLKSADACKLITGSRWRRGLGLRRKRWFWVRVKMQAKAKGEANKMAAAHRFDAMRA

SEQ ID NO: 9966 - protein, 23 aa, Artificial Sequence
  Computer-generated peptide variant
RFRLFKKLLKRIRSSALRLRCGA

SEQ ID NO: 9967 - protein, 66 aa, Artificial Sequence
  Computer-generated peptide variant
RLKLLRRMLRKMTKHRIRSDLHAPRGSLRAAARWNSMMAKWMELALWAHMHRAARAANQAWDKWKQ

SEQ ID NO: 9968 - protein, 57 aa, Artificial Sequence
  Computer-generated peptide variant
RFKLMRRLYRKFSRKLRLARKDVKSFKIYASQDALVTTALLDRKITLADRFTLKARA

SEQ ID NO: 9969 - protein, 28 aa, Artificial Sequence
  Computer-generated peptide variant
ILKLLKRFFKRMKRQAAKATELHKLLKE

SEQ ID NO: 9970 - protein, 62 aa, Artificial Sequence
  Computer-generated peptide variant
RLRLYKRLIKRFQKGGKALAKKASRYWVFKLARLAPWKPHDLRAVYDAKKFAHDDAFQDKLK

SEQ ID NO: 9971 - protein, 54 aa, Artificial Sequence
  Computer-generated peptide variant
FMRFWKRFYKFLHKMNDKALAKSRRAGWRALAVHLDNLVCQARLKLARLWRAFE

SEQ ID NO: 9972 - protein, 66 aa, Artificial Sequence
  Computer-generated peptide variant
LFKFFRKYLKKLRTLWRNWSLIRALALLQKALAAYKRRAEKKHPNFRLHRGLCSLLKTHQNLEVRT

SEQ ID NO: 9973 - protein, 42 aa, Artificial Sequence
  Computer-generated peptide variant
LLKLITKFMRKLCQTHLEKLTKTREAAVRLRQELNLARYRKL

SEQ ID NO: 9974 - protein, 64 aa, Artificial Sequence
  Computer-generated peptide variant
KIRIMKRFWRMLRRFLPRRKLKLAWLWCNLKAFLRLLAAKFAKTRSCKRSLPNLMPNALLIHSV

SEQ ID NO: 9975 - protein, 36 aa, Artificial Sequence
  Computer-generated peptide variant
RFKIFKRFFKKLNKAAGRSAQIYRKPALMLLLANAR

SEQ ID NO: 9976 - protein, 21 aa, Artificial Sequence
  Computer-generated peptide variant
KLKLYKRLYKLLTKRWKLEAV

SEQ ID NO: 9977 - protein, 40 aa, Artificial Sequence
  Computer-generated peptide variant
KMKMLHKLLRLLKKCARNKEKVVHRARKMEQQPARDEVHA

SEQ ID NO: 9978 - protein, 53 aa, Artificial Sequence
  Computer-generated peptide variant
KMKLWRRIMKRFSRDLPALAFTTALHSAKAKSHFKAPKSWQLLLKLKRAPMKT

SEQ ID NO: 9979 - protein, 24 aa, Artificial Sequence
  Computer-generated peptide variant
KYKLWCKMFKKLKHANYCLALADL

SEQ ID NO: 9980 - protein, 65 aa, Artificial Sequence
  Computer-generated peptide variant
RFKLFRRLLRWYKRKCAKRARLAAAKACDKGLNGVAVSRDKKLCSPNKSPAMMWLKVARRAYDDG

SEQ ID NO: 9981 - protein, 74 aa, Artificial Sequence
  Computer-generated peptide variant
YYRILRKFLRFWKKELCIWWKKCKLLNANLKHALLKLAWYRYMAKKCFKMLLWSRVADYVLRLVCGLKAKVKHK

SEQ ID NO: 9982 - protein, 58 aa, Artificial Sequence
  Computer-generated peptide variant
KIRIFRRFYKRYKKYEGEQRDKLALAFNIRALRRRCERFLLYLVWADAVVKLVQALKK

SEQ ID NO: 9983 - protein, 22 aa, Artificial Sequence
  Computer-generated peptide variant
YMRLLKKMLRFWRRATHGARLQ

SEQ ID NO: 9984 - protein, 22 aa, Artificial Sequence
  Computer-generated peptide variant
KWKYFRRILKKLSNAKILTADL

SEQ ID NO: 9985 - protein, 49 aa, Artificial Sequence
  Computer-generated peptide variant
KMKIIKKLWRFLRKRWWLDMVANRAADRLHVAARRLYAKWKEKTAKYMI

SEQ ID NO: 9986 - protein, 26 aa, Artificial Sequence
  Computer-generated peptide variant
WFRMYKKLYKLFRRLNKRARAPKLLA

SEQ ID NO: 9987 - protein, 25 aa, Artificial Sequence
  Computer-generated peptide variant
KFRFWTRLFKLLKNDKNYKWNALKA

SEQ ID NO: 9988 - protein, 41 aa, Artificial Sequence
  Computer-generated peptide variant
KLRWLKKLIKRYKKMRLISAPAYLAAWHAQLHARCMCLLKH

SEQ ID NO: 9989 - protein, 53 aa, Artificial Sequence
  Computer-generated peptide variant
RFKLYHKLYKFLCPLNLRTYLHWAAELIRAFKLYKRRKRAAHWFKRLMNAAER

SEQ ID NO: 9990 - protein, 60 aa, Artificial Sequence
  Computer-generated peptide variant
KLKYFKKFMKKMKCRMTMLYKNALMRRRFASKAKASWAFDLLWRLELAAVHAWHQAEEKA

SEQ ID NO: 9991 - protein, 23 aa, Artificial Sequence
  Computer-generated peptide variant
IIRLLTKWMKKLKHALLHKQAER

SEQ ID NO: 9992 - protein, 67 aa, Artificial Sequence
  Computer-generated peptide variant
FLRYFRRLLKKICPKKSEDAVAKKARALLVKGAILVMRLFLIKNDCMRLMREKTTKARRKCAEPYYL

SEQ ID NO: 9993 - protein, 44 aa, Artificial Sequence
  Computer-generated peptide variant
MFKLIKKWFRLLTNHAEALLKARRRHQDNCAKQKLTVASAKRKL

SEQ ID NO: 9994 - protein, 58 aa, Artificial Sequence
  Computer-generated peptide variant
RIKILRKFIRKLRNMLKAKLARKEARDILGMYKTERRLAIKMRAAVRLPRLMMKLLRA

SEQ ID NO: 9995 - protein, 28 aa, Artificial Sequence
  Computer-generated peptide variant
RFRLFNKFFRLLTKISRAAAKDSRLLFA

SEQ ID NO: 9996 - protein, 32 aa, Artificial Sequence
  Computer-generated peptide variant
FMRLLKRFYRFYHKRALRHRNLLCRRKAQLLL

SEQ ID NO: 9997 - protein, 56 aa, Artificial Sequence
  Computer-generated peptide variant
LFKYYTRIFRKLHRFLRQARHKNHLLKLKSAKAKDRTKCTDLFVNKWRRLAAEILL

SEQ ID NO: 9998 - protein, 28 aa, Artificial Sequence
  Computer-generated peptide variant
RFRWWKRIYKRIKKLAFLSLDRLTALIH

SEQ ID NO: 9999 - protein, 35 aa, Artificial Sequence
  Computer-generated peptide variant
LLKIFKRILRFLRRNYLADLRELSLKRARPWLHHA

SEQ ID NO: 10000 - protein, 34 aa, Artificial Sequence
  Computer-generated peptide variant
RLRMWRKLLKKYKCLKRADKAAPAKRSEFAGLAT

SEQ ID NO: 10001 - protein, 28 aa, Artificial Sequence
  Computer-generated peptide variant
FWRMWKRLLRRFKKTNLAKLPHAHLAAL

SEQ ID NO: 10002 - protein, 54 aa, Artificial Sequence
  Computer-generated peptide variant
LLKMWKRYFRLLTSKIRRENPSLNGKKKRAQFLLRAHLPKHGGCAARGNRRQKA

SEQ ID NO: 10003 - protein, 46 aa, Artificial Sequence
  Computer-generated peptide variant
KLRIFHKMIRFFHRKVHRKKKLAHSNLLRKDADMRGNTLALLLKAT

SEQ ID NO: 10004 - protein, 25 aa, Artificial Sequence
  Computer-generated peptide variant
WYRLWHKLLRKFKSRGLLRETTYKA

SEQ ID NO: 10005 - protein, 29 aa, Artificial Sequence
  Computer-generated peptide variant
LWRLFNRWLKLFSRLETLWAYLQPLKRPK

SEQ ID NO: 10006 - protein, 41 aa, Artificial Sequence
  Computer-generated peptide variant
KFRLLKRLLKKLNRKHAEPHRIAAACANHKHWRYIAAMEKN

SEQ ID NO: 10007 - protein, 28 aa, Artificial Sequence
  Computer-generated peptide variant
RLKIYTKYYKYLRRLKLKKHLCLECNDL

SEQ ID NO: 10008 - protein, 61 aa, Artificial Sequence
  Computer-generated peptide variant
KWKIFKKWWKKWCPTMPLLTAARKWCKAPCQLHLRAGLWDAACKKAKRRKRFTIALLLRRA

SEQ ID NO: 10009 - protein, 30 aa, Artificial Sequence
  Computer-generated peptide variant
LLRFMKRFWKRFRRAKASRARALQFCQIPC

SEQ ID NO: 10010 - protein, 27 aa, Artificial Sequence
  Computer-generated peptide variant
IIRLLRRMLRMISRRVLKMTACAGKLY

SEQ ID NO: 10011 - protein, 64 aa, Artificial Sequence
  Computer-generated peptide variant
RLKMLRKYLKRLCRRRMKLKTNAYETHIKRTYWMQYCEEKQAALRLLKAPACKDKPAAFLAAIL

SEQ ID NO: 10012 - protein, 31 aa, Artificial Sequence
  Computer-generated peptide variant
LYKLYTKMYRFLNRLQKHPARIKRAELLVRK

SEQ ID NO: 10013 - protein, 58 aa, Artificial Sequence
  Computer-generated peptide variant
KWKWFHKILRLLPKALRRAGYYQQLKKYKLLRRRQRVYATISFWWAIKRNAKLLALKG

SEQ ID NO: 10014 - protein, 45 aa, Artificial Sequence
  Computer-generated peptide variant
RLKFYKKFLRLLRHALQARKNLDFFRHYKPKKWGDLRCAVWLKDC

SEQ ID NO: 10015 - protein, 20 aa, Artificial Sequence
  Computer-generated peptide variant
RMKWFHRLLRLYKKLKNWHL

SEQ ID NO: 10016 - protein, 34 aa, Artificial Sequence
  Computer-generated peptide variant
RLRFFTKFFRWYKRLEALKRHAWRLDSGHLRLKQ

SEQ ID NO: 10017 - protein, 43 aa, Artificial Sequence
  Computer-generated peptide variant
MMKFIRRIIKRLRPSLLNYAAKEEADARKIKSIALWLKLILRF

SEQ ID NO: 10018 - protein, 43 aa, Artificial Sequence
  Computer-generated peptide variant
KLKWLRKIYRYLQNKRRLDRRVYRKVTHRWLPAFWANALLTKG

SEQ ID NO: 10019 - protein, 41 aa, Artificial Sequence
  Computer-generated peptide variant
RLKWLKKLMRFYRKADKHCQALYLERLLNRRFLYLSTVFMK

SEQ ID NO: 10020 - protein, 28 aa, Artificial Sequence
  Computer-generated peptide variant
WMRYLKRLYRMYRRNAYLLYDAAKMVAK

SEQ ID NO: 10021 - protein, 56 aa, Artificial Sequence
  Computer-generated peptide variant
LLKLLRRLYRKMNPHASANSCCACAHFKWAKAKNECLALWKIKRKHTHYKPHLKAL

SEQ ID NO: 10022 - protein, 27 aa, Artificial Sequence
  Computer-generated peptide variant
ILKIFKRYWRLIKRRKLYLLPTTLMPA

SEQ ID NO: 10023 - protein, 69 aa, Artificial Sequence
  Computer-generated peptide variant
MLRYLRKLMKRLTTYRWKAHTRNQKLAFKKRLVIRVRARLRELPRHALAYLIRGPLTYLYKHLQGKTLA

SEQ ID NO: 10024 - protein, 25 aa, Artificial Sequence
  Computer-generated peptide variant
LIKFYNRWLRRFPSKAKLRSKLCSL

SEQ ID NO: 10025 - protein, 87 aa, Artificial Sequence
  Computer-generated peptide variant
LWKYMRKLWKIFKNQCAKDREMAARRKIYSYRPRVLRCAALRLKRADKMPALSKKARHLRHKCLSHSLWLEAARLGKKAFAPRLWKK

SEQ ID NO: 10026 - protein, 25 aa, Artificial Sequence
  Computer-generated peptide variant
WWKYMKKFWRLWRRRKFAALLSLWC

SEQ ID NO: 10027 - protein, 31 aa, Artificial Sequence
  Computer-generated peptide variant
RLRYLRKYIKKLTHRYKERTRARATAVFLML

SEQ ID NO: 10028 - protein, 40 aa, Artificial Sequence
  Computer-generated peptide variant
RFKMFPRFLKLLRQQWEASLLKAVIRKWKRTQEADAFRRL

SEQ ID NO: 10029 - protein, 34 aa, Artificial Sequence
  Computer-generated peptide variant
KFKLFHKWFRWYKRRGRFEALWRKYLAPVRPALL

SEQ ID NO: 10030 - protein, 33 aa, Artificial Sequence
  Computer-generated peptide variant
KFKYLQKLMRKLSRAVAKGRLLLLYSLGRFLVC

SEQ ID NO: 10031 - protein, 44 aa, Artificial Sequence
  Computer-generated peptide variant
RFRILRKLFKKLHKARSDMKAEFLRLRADLMHNADQINLLRNAY

SEQ ID NO: 10032 - protein, 53 aa, Artificial Sequence
  Computer-generated peptide variant
FIRYFQRLLKWWRTALRYRAQNKMKTASSILLQKLKRWLALTLKLKPFLKQDK

SEQ ID NO: 10033 - protein, 20 aa, Artificial Sequence
  Computer-generated peptide variant
LWRFFQKLWRRFKRKAANAE

SEQ ID NO: 10034 - protein, 45 aa, Artificial Sequence
  Computer-generated peptide variant
RLKWWCKILRKLRRNLHARLRFLRGATFRAAKMSYQKQAARRLGN

SEQ ID NO: 10035 - protein, 57 aa, Artificial Sequence
  Computer-generated peptide variant
YFRLMKRWMRKFSKPKRAKLLRLRRLVNLCPRLLRCCQCKRMELKLCILRAAHLRQL

SEQ ID NO: 10036 - protein, 80 aa, Artificial Sequence
  Computer-generated peptide variant
KWRFWKRLLRKLTKRAPALMAANYKFARLAARTAANLDQVLLDIICHAGVYKKKLKFLKFGERLVKLKPQICLVRRTGMP

SEQ ID NO: 10037 - protein, 32 aa, Artificial Sequence
  Computer-generated peptide variant
KLRLWQRILKFLRKSDLLRDRPCRFARLSQAR

SEQ ID NO: 10038 - protein, 27 aa, Artificial Sequence
  Computer-generated peptide variant
LMKYWNRYLKWFRRKRQAALKLELSKI

SEQ ID NO: 10039 - protein, 41 aa, Artificial Sequence
  Computer-generated peptide variant
IYRYLQRLMRLFSPWLRVSKRLKMRFKLLAKRLRSLGMYKQ

SEQ ID NO: 10040 - protein, 70 aa, Artificial Sequence
  Computer-generated peptide variant
KYKLLRRLLKLIHKQGSLAYCTYAKRMKAGTLPKACAKRNLVMDAKYDIHRAHKYAKPKKLMLDRNARKS

SEQ ID NO: 10041 - protein, 29 aa, Artificial Sequence
  Computer-generated peptide variant
RFKYFKRLYKRWPRKLLLRAEHALYVLLL

SEQ ID NO: 10042 - protein, 38 aa, Artificial Sequence
  Computer-generated peptide variant
RLRYIRKFWRRMKRLCKAAARFFMAACLCSKRLQPVCG

SEQ ID NO: 10043 - protein, 47 aa, Artificial Sequence
  Computer-generated peptide variant
KFKFLKKWLRRWKRMEAKLKAKAGKLAKLLKRLQYNMVLVRPHPLSK

SEQ ID NO: 10044 - protein, 45 aa, Artificial Sequence
  Computer-generated peptide variant
RIRLMKKFYRLYKHVYKTSPAPMKARAIAKFKIALRLAHDVARRR

SEQ ID NO: 10045 - protein, 27 aa, Artificial Sequence
  Computer-generated peptide variant
FFKLFRRLLKRLCTGAKLRSVLNAKNK

SEQ ID NO: 10046 - protein, 47 aa, Artificial Sequence
  Computer-generated peptide variant
LFRMLSRFMKRFNCKLAAKLRQKRRCKRALRAHKALARRKPEARLQI

SEQ ID NO: 10047 - protein, 44 aa, Artificial Sequence
  Computer-generated peptide variant
RLRILPKFIRKMHCPRAYPKVGILKQAHLRKPARTALAAKLRRR

SEQ ID NO: 10048 - protein, 88 aa, Artificial Sequence
  Computer-generated peptide variant
LWKFMCRMFKRLKKFRCLHVKRTPVMLSWELVMSKAIGRYAKLLKEYKLLHAIQRSKKKAIKALGARLHNAALLERCRCALRMGKYAL

SEQ ID NO: 10049 - protein, 40 aa, Artificial Sequence
  Computer-generated peptide variant
RMKYIRRILKMWQTSHLVVRALAATKQLALKTAYMFAKLK

SEQ ID NO: 10050 - protein, 23 aa, Artificial Sequence
  Computer-generated peptide variant
KFRWLKKMIKYLSSRKELLVFAL

SEQ ID NO: 10051 - protein, 20 aa, Artificial Sequence
  Computer-generated peptide variant
RYKLWKRFLKKLRQSPAASW

SEQ ID NO: 10052 - protein, 20 aa, Artificial Sequence
  Computer-generated peptide variant
KYRFLKRMWRKLNHALALLS

SEQ ID NO: 10053 - protein, 37 aa, Artificial Sequence
  Computer-generated peptide variant
KMRFLSRWLRYYKRLAMQLDASRWAKRKLANKDGRQS

SEQ ID NO: 10054 - protein, 26 aa, Artificial Sequence
  Computer-generated peptide variant
FMKYLKRLLRKFRKRAELARNVYMLC

SEQ ID NO: 10055 - protein, 37 aa, Artificial Sequence
  Computer-generated peptide variant
MMKYLSKYYRKFKRWAAGRFARDWKALVASKQLAMAK

SEQ ID NO: 10056 - protein, 57 aa, Artificial Sequence
  Computer-generated peptide variant
LLKLICRFLKRLKCFMKPCHLFHRHNTRWLLLVVFLADIARCAFVARRRKKDIRRKK

SEQ ID NO: 10057 - protein, 62 aa, Artificial Sequence
  Computer-generated peptide variant
RLKIFKKFYRYLRCRQGRQTLAAAKKAMAQRRAKERALSRNAELRAEANATYAVAKWEPCAK

SEQ ID NO: 10058 - protein, 56 aa, Artificial Sequence
  Computer-generated peptide variant
IYKLYKKFLRRIRRPRARLRAKRMLRVEFLLKLNRVPAFIKQLAYVLEKRICGHWL

SEQ ID NO: 10059 - protein, 28 aa, Artificial Sequence
  Computer-generated peptide variant
FLRMFKKLLRWLSPAKATAKSCLIRYRM

SEQ ID NO: 10060 - protein, 55 aa, Artificial Sequence
  Computer-generated peptide variant
YLRWISRMLRKFHRLLACRRDGRKLNKGLWHRADCKWIAIGLRKKFRKLEKLTLC

SEQ ID NO: 10061 - protein, 68 aa, Artificial Sequence
  Computer-generated peptide variant
KMKMIHKLLKFLKRHFLARAPPHAWRLLTAACQEKLSTKCRRILTSKFKKLTIAAKEYPLLRDKWWLA

SEQ ID NO: 10062 - protein, 25 aa, Artificial Sequence
  Computer-generated peptide variant
RYRLFCKIWKLMCRLSLKASQLLTR

SEQ ID NO: 10063 - protein, 51 aa, Artificial Sequence
  Computer-generated peptide variant
RLKILKKFFRRFCRMVKKLKFPAAAQKAVCATLRLEMVLFAALRHFRHPKA

SEQ ID NO: 10064 - protein, 33 aa, Artificial Sequence
  Computer-generated peptide variant
FLRFLRKFWKKLPPLRPAGARRRRLKRATAWNP

SEQ ID NO: 10065 - protein, 70 aa, Artificial Sequence
  Computer-generated peptide variant
IFRMLRKLMKKLSPKYLAKARLALWLAARWDGMYLVAAACFRASKLHRLRKPRMKKTACKRRRKRLTWPD

SEQ ID NO: 10066 - protein, 41 aa, Artificial Sequence
  Computer-generated peptide variant
RLRIFRRLIKLMKKRYEAFCMAIKADRRKAVALAALSHQTD

SEQ ID NO: 10067 - protein, 84 aa, Artificial Sequence
  Computer-generated peptide variant
RLRMFRKILKLMQRWGGTLRKLRLAGQDFIKPKCLFFLLNKKALFYAPCALQRLALDGRLRKMCAALLAQRWPSKKVAAQCQRW

SEQ ID NO: 10068 - protein, 69 aa, Artificial Sequence
  Computer-generated peptide variant
LYRWMPRYLKKLKRAMRLGKMLAIKANPDERLMEAAAKKILSIERATRLSMLKAKLMTLKKLRTQHYAC

SEQ ID NO: 10069 - protein, 49 aa, Artificial Sequence
  Computer-generated peptide variant
RLRWIQKLIKRWRRMHKREASADKMGAADWKKKHALLRWLGLAKLAECR

SEQ ID NO: 10070 - protein, 37 aa, Artificial Sequence
  Computer-generated peptide variant
FWKLLSKLWRLLCKLVQRTTRFDRRALFKSAIRARKK

SEQ ID NO: 10071 - protein, 23 aa, Artificial Sequence
  Computer-generated peptide variant
RYKYYTKLYKRFSKLLRLAPLAP

SEQ ID NO: 10072 - protein, 37 aa, Artificial Sequence
  Computer-generated peptide variant
RLRFLKKFWKKWRHAKVNRDAAAYALDKAAHDATVYY

SEQ ID NO: 10073 - protein, 29 aa, Artificial Sequence
  Computer-generated peptide variant
KWKFYNKLFKYLKHAMARKDQCRLAACLF

SEQ ID NO: 10074 - protein, 47 aa, Artificial Sequence
  Computer-generated peptide variant
RFRLFKKLYKFWKKAKLLFCAAFEITCTRELMSSKLKARLLDCAAHM

SEQ ID NO: 10075 - protein, 46 aa, Artificial Sequence
  Computer-generated peptide variant
LLKLLKKLFKKMKRAFHLKLCKKDALLSPWMYHKSDHPKRERKMFQ

SEQ ID NO: 10076 - protein, 32 aa, Artificial Sequence
  Computer-generated peptide variant
RYKIYRRLIRIFKRKLNTWKLAERERLLACLP

SEQ ID NO: 10077 - protein, 20 aa, Artificial Sequence
  Computer-generated peptide variant
RWKLWRKFLKRLKNAGCNNL

SEQ ID NO: 10078 - protein, 24 aa, Artificial Sequence
  Computer-generated peptide variant
LLKWFHKWYRYFRKAYFDARRALR

SEQ ID NO: 10079 - protein, 63 aa, Artificial Sequence
  Computer-generated peptide variant
RMRMLKRFLKRMKKRPLELVLFKPKANKRLQLYLQLAGPYRLQAGAVRFKLREVRCLRRQAAL

SEQ ID NO: 10080 - protein, 24 aa, Artificial Sequence
  Computer-generated peptide variant
RLRMLQKFFKILKKSLLAPLNFCR

SEQ ID NO: 10081 - protein, 38 aa, Artificial Sequence
  Computer-generated peptide variant
FLKFWHKILKLLKRTAYKLRKRDILERSSHFASTGALA

SEQ ID NO: 10082 - protein, 32 aa, Artificial Sequence
  Computer-generated peptide variant
ILKMFRKLLKFMRRLKLKKNLVKLTNWSTCAI

SEQ ID NO: 10083 - protein, 94 aa, Artificial Sequence
  Computer-generated peptide variant
FLKLFRRMWRRFKRFVAAHPPFECSKTLQNLLKQLLKDDQWARAHLEKRRAPKNLAALKNKNQLLRLRLYRRGLRSREIAPATLYACELALAKH

SEQ ID NO: 10084 - protein, 33 aa, Artificial Sequence
  Computer-generated peptide variant
KLRFISRLIRKFRSWRLLWLPSAAKMRLCTAKL

SEQ ID NO: 10085 - protein, 37 aa, Artificial Sequence
  Computer-generated peptide variant
MFRILSKLLRKMCKQMAFRKLKLTKARRACQEKLWWD

SEQ ID NO: 10086 - protein, 32 aa, Artificial Sequence
  Computer-generated peptide variant
KLRMFNRLLRFIKRDAAHNNRCILLVKLHAYA

SEQ ID NO: 10087 - protein, 27 aa, Artificial Sequence
  Computer-generated peptide variant
WYKLICKMFRRLRKKRAAATIDWMLLM

SEQ ID NO: 10088 - protein, 41 aa, Artificial Sequence
  Computer-generated peptide variant
FFRLLRKFLKRLCPLALLYARVKYAEQWNRARTPRIMRRAM

SEQ ID NO: 10089 - protein, 32 aa, Artificial Sequence
  Computer-generated peptide variant
LIKMLRKLLKKFHSVHAHRRRSTLLGRHRHAR

SEQ ID NO: 10090 - protein, 30 aa, Artificial Sequence
  Computer-generated peptide variant
KLKLLRRWWRRFNPAPRADKHNLMMSTAKA

SEQ ID NO: 10091 - protein, 89 aa, Artificial Sequence
  Computer-generated peptide variant
KIKLLHKYMRKFRRAAKTDGRLAEMRRPYKLLACLKKAQFRNPLLLTPLDLDALVMRDLLKVLRLLRLMRTNLSPWWASGRKPRFKKAC

SEQ ID NO: 10092 - protein, 25 aa, Artificial Sequence
  Computer-generated peptide variant
YLKLLNKFLKIISNRKLMRQAWKIR

SEQ ID NO: 10093 - protein, 34 aa, Artificial Sequence
  Computer-generated peptide variant
LWKWFNRFFRKLKRARHNLLPKACKKSLKYALRV

SEQ ID NO: 10094 - protein, 39 aa, Artificial Sequence
  Computer-generated peptide variant
LLRFYRRLFRIWKRLEKEAEFRLRLHHWMQLLAPALYKL

SEQ ID NO: 10095 - protein, 65 aa, Artificial Sequence
  Computer-generated peptide variant
KLRFLCRLLKMITKQLKALALTKAKALRAIGRQVISFRRAMRQANRRAIKRTCSQCLFLATRLAN

SEQ ID NO: 10096 - protein, 48 aa, Artificial Sequence
  Computer-generated peptide variant
LFRLMHRLFKYLRRAAVLAWRLIMNHKKGMLGRKRTFHFYKACKLYKA

SEQ ID NO: 10097 - protein, 67 aa, Artificial Sequence
  Computer-generated peptide variant
KWKLLKRLWKFWKRSAWAARRFKDKWLAAAKPVNAKLRKFELEKLGGNPLRRCADLSDLAFPAKPMR

SEQ ID NO: 10098 - protein, 96 aa, Artificial Sequence
  Computer-generated peptide variant
KLKWMCKLMKKLRKRPTKWIMYLRWQEEALARFPQAMRRPYARDRMMLAVKEKALRPKKLGRDRLAFAPARKRRRLKQNILLAQGATKHEENLRYR

SEQ ID NO: 10099 - protein, 30 aa, Artificial Sequence
  Computer-generated peptide variant
KMKIFRRLFKKFRKALNQKREQSLLHLSLV

SEQ ID NO: 10100 - protein, 76 aa, Artificial Sequence
  Computer-generated peptide variant
KIRILKKLLRRFCKCDKIYMLERRLSTFAKLRAMRLASLQRAAIAKWWKHCHLEYGQDTKKATKAIKDAGRLAMSR

SEQ ID NO: 10101 - protein, 92 aa, Artificial Sequence
  Computer-generated peptide variant
KIKFLKKYLKRLRPKLYGLSIRRRTYEKGNFADRLQLSLCKPRRATKALDKLIVPAGKRPNAKMSSGLDAAKRLAQRAMLPWPRPLNAKQAL

SEQ ID NO: 10102 - protein, 39 aa, Artificial Sequence
  Computer-generated peptide variant
KFKWLHRYIRIIKRRADLLKCDLRRLCMLAQFARWMALN

SEQ ID NO: 10103 - protein, 45 aa, Artificial Sequence
  Computer-generated peptide variant
RIKLMSRLFKRFRKRALSKAAQLSASRIYMARANHKWQRWDLLEL

SEQ ID NO: 10104 - protein, 59 aa, Artificial Sequence
  Computer-generated peptide variant
RYKLMRRLLRKLKRGCAIAKAGQPLALLPRKMEAGTVQWKLDRLWWDAKRKKFAVSRRE

SEQ ID NO: 10105 - protein, 25 aa, Artificial Sequence
  Computer-generated peptide variant
WFRLLRKLLKLLHRCRAWRGLKRSV

SEQ ID NO: 10106 - protein, 32 aa, Artificial Sequence
  Computer-generated peptide variant
RIRLLRKLWRWMKNQIKYTQLAPLFRALLWRN

SEQ ID NO: 10107 - protein, 29 aa, Artificial Sequence
  Computer-generated peptide variant
RLRLFHKMLRWFPKALRFMLIIRREIRPA

SEQ ID NO: 10108 - protein, 21 aa, Artificial Sequence
  Computer-generated peptide variant
LMRMLRRWWRRFHRLARKAIA

SEQ ID NO: 10109 - protein, 74 aa, Artificial Sequence
  Computer-generated peptide variant
RLKLWRKLMRLYKKYWLDLPLALLGAYWKKVLKTWDRAPKSNRLNNRLKRAPAHLKYNIDADLFNIIRKGKARK

SEQ ID NO: 10110 - protein, 30 aa, Artificial Sequence
  Computer-generated peptide variant
RWKYYTKFLKLIKPLDRRLAWNADAKANLR

SEQ ID NO: 10111 - protein, 34 aa, Artificial Sequence
  Computer-generated peptide variant
KMRFINKWLKRLKCLRMACHEYPRKALALKMLDA

SEQ ID NO: 10112 - protein, 44 aa, Artificial Sequence
  Computer-generated peptide variant
KWKLYTRLFRKLHKKYARLCKNKWADQLCLPCAKLWDMLVLLMK

SEQ ID NO: 10113 - protein, 29 aa, Artificial Sequence
  Computer-generated peptide variant
RLRFLRKYLKIFRREAAYGLHKYLWRVQQ

SEQ ID NO: 10114 - protein, 25 aa, Artificial Sequence
  Computer-generated peptide variant
FFRLIRRLLKLLTRDRADLPIKVQR

SEQ ID NO: 10115 - protein, 82 aa, Artificial Sequence
  Computer-generated peptide variant
KLRMLRKMLKRYHRYAAGCIGTALHQGRLDKALAKEADYGKKLVPLFALRYKKHKGARNMGAAAVKLVAADRLYWLKRSCKK

SEQ ID NO: 10116 - protein, 34 aa, Artificial Sequence
  Computer-generated peptide variant
FYKIFHKWMKFFKRKKPALVKKELQLLLLWLRNK

SEQ ID NO: 10117 - protein, 32 aa, Artificial Sequence
  Computer-generated peptide variant
MLRFLPKYLKKFKKSGKRLLYRRALHKLCLPW

SEQ ID NO: 10118 - protein, 25 aa, Artificial Sequence
  Computer-generated peptide variant
RFKLLTKFLKKYKTASKAHKLPARG

SEQ ID NO: 10119 - protein, 47 aa, Artificial Sequence
  Computer-generated peptide variant
KFKWLKRFLRLFRCKKEANVRARIRVVTKSPAKEKYRELLANNAYLC

SEQ ID NO: 10120 - protein, 27 aa, Artificial Sequence
  Computer-generated peptide variant
WLKLLRRFLKLFTRGEEAGKAHRQPPR

SEQ ID NO: 10121 - protein, 90 aa, Artificial Sequence
  Computer-generated peptide variant
KMRWFTKLLKLLKTAAYHARRLWVRKHKIKLYRYACKKKLRICRYAHTEYAFPRDWIAKENLNRAWRKYRAQRCAAKQLILGCALYRLKL

SEQ ID NO: 10122 - protein, 26 aa, Artificial Sequence
  Computer-generated peptide variant
LWRLFHRFLKFFPPRRQILKAYLRAK

SEQ ID NO: 10123 - protein, 38 aa, Artificial Sequence
  Computer-generated peptide variant
RFRMLRKIYKLINKAMFKARIHSKALHLALLKHKKHLA

SEQ ID NO: 10124 - protein, 34 aa, Artificial Sequence
  Computer-generated peptide variant
MFRYWNKFLRRYPKKTLKRPLAPPRLHHLQRAAK

SEQ ID NO: 10125 - protein, 31 aa, Artificial Sequence
  Computer-generated peptide variant
RMKILSKIIRLLKKYLACKPAKTKLLPNHKW

SEQ ID NO: 10126 - protein, 54 aa, Artificial Sequence
  Computer-generated peptide variant
LYKLLKKLWKKFKPCSNDTQACAAYARLYVLKLAAFTKCNKTMTKYPKRRRDAR

SEQ ID NO: 10127 - protein, 34 aa, Artificial Sequence
  Computer-generated peptide variant
RLKLLKKIIRRLKQLRAAIGRRLCRRLAMAKFAS

SEQ ID NO: 10128 - protein, 97 aa, Artificial Sequence
  Computer-generated peptide variant
KLRIIHRMFKFFKRTTLADLMIQRPTASARKIRKFFKAFRAKLNAKREQCEAANKLDSALLLAKELKPLKKKAKRCKLNRLRIFKLKAFPKLGHAFL

SEQ ID NO: 10129 - protein, 65 aa, Artificial Sequence
  Computer-generated peptide variant
KWKMFRRMWKRLNKKSKVLLAALLSRIKIYTRGNALVKALITKHRKYNAWKLMERNLAKNDRYKI

SEQ ID NO: 10130 - protein, 30 aa, Artificial Sequence
  Computer-generated peptide variant
FLRFLPRWLRLLKRQRFLSLLNLHPRWKSL

SEQ ID NO: 10131 - protein, 20 aa, Artificial Sequence
  Computer-generated peptide variant
YIKLLRKYLRKYHCIALDAT

SEQ ID NO: 10132 - protein, 74 aa, Artificial Sequence
  Computer-generated peptide variant
KWKLWRKLMKLLKRGVACRKRTKQTAAAQHREKGRRYDTCHGRKKRDAWKYKCAHEKAAYATILEAKNLEAFKH

SEQ ID NO: 10133 - protein, 38 aa, Artificial Sequence
  Computer-generated peptide variant
LLRWWRRYWKKLRTSLVTYDLHTKLKYLARFDRKGLGR

SEQ ID NO: 10134 - protein, 80 aa, Artificial Sequence
  Computer-generated peptide variant
RLKMLHKWFRFLKRAKALKTWALSARMSFPCETSASHLAQRIWKYRKSARDLHQCAAALRKCAARLKIKRHYCDKKAALK

SEQ ID NO: 10135 - protein, 40 aa, Artificial Sequence
  Computer-generated peptide variant
KMKMFHRLFRRLTRLTHLLRATDDLKTAARYKKAFDGAKK

SEQ ID NO: 10136 - protein, 36 aa, Artificial Sequence
  Computer-generated peptide variant
LYRLWKKLMRYFTRKATNRPRLSADLAKRQYHMLAA

SEQ ID NO: 10137 - protein, 50 aa, Artificial Sequence
  Computer-generated peptide variant
RYRFYTRYYKKLKRRFANQAGNAREAQRAARLAKYAGRDTKGLKFILLQQ

SEQ ID NO: 10138 - protein, 34 aa, Artificial Sequence
  Computer-generated peptide variant
MWKYLKRFLKMLSRKLIDQKWALLAYRLKGYKND

SEQ ID NO: 10139 - protein, 32 aa, Artificial Sequence
  Computer-generated peptide variant
WWKMMRRLMKRMRKRWAAALADNKLKCGAMYR

SEQ ID NO: 10140 - protein, 47 aa, Artificial Sequence
  Computer-generated peptide variant
KMRFLSRWLRFFRCAKLCYAAELLRYALHDCRLAKNKAKRAKRHCKN

SEQ ID NO: 10141 - protein, 34 aa, Artificial Sequence
  Computer-generated peptide variant
RLKYFRKFLKRWQRACQAAKNRHLVGKDVAAGKL

SEQ ID NO: 10142 - protein, 31 aa, Artificial Sequence
  Computer-generated peptide variant
LLKLLSRMLRFIPSKPRKLSLAWRRWCAKLY

SEQ ID NO: 10143 - protein, 54 aa, Artificial Sequence
  Computer-generated peptide variant
KFKLYHKLLRLWNCKRRDKLWELRLKPNANRKAKVHKKEALARMWWYLKMMTWS

SEQ ID NO: 10144 - protein, 21 aa, Artificial Sequence
  Computer-generated peptide variant
LIRLFPKYLRLIRRHKKSGLE

SEQ ID NO: 10145 - protein, 61 aa, Artificial Sequence
  Computer-generated peptide variant
LFRFYCKLLRKLTQYYVLKLKCKLLLKRKLRALRMYEYKLKACPVRAKKTPKMARSSYMKI

SEQ ID NO: 10146 - protein, 78 aa, Artificial Sequence
  Computer-generated peptide variant
YFRLLKRMLKFFCRNIACYRSAAGTNLIRLNWPELKCKARAWKICTLLKKADIERLRALAKKCLPGAAPRPTKLRAFA

SEQ ID NO: 10147 - protein, 61 aa, Artificial Sequence
  Computer-generated peptide variant
IYRFYRRFLKKFPKSTKKKGEYAKLTCLRPLRADLLLERALAMALYPRCRRLRALLTRYLF

SEQ ID NO: 10148 - protein, 75 aa, Artificial Sequence
  Computer-generated peptide variant
LYRLWRRLFRRIRPLLKRSMLSAPANAWDYAAKRYRLRKPEKFILLSLLTCKGNRDLALLVVAKRKSPFQRCWLK

SEQ ID NO: 10149 - protein, 53 aa, Artificial Sequence
  Computer-generated peptide variant
WYKLFKRFFKRLNRALYANHVRKQAHRIHLSTLFQDARGLKRLAAWRAKLVKW

SEQ ID NO: 10150 - protein, 32 aa, Artificial Sequence
  Computer-generated peptide variant
WLKLLSKMIKKISTKLAKRLAPCHRRADNRCH

SEQ ID NO: 10151 - protein, 21 aa, Artificial Sequence
  Computer-generated peptide variant
LLRYWRRYLKLWSTTKKKLWL

SEQ ID NO: 10152 - protein, 30 aa, Artificial Sequence
  Computer-generated peptide variant
KIRLYQRYLRLLKSYHKRWRAELAIAMYMR

SEQ ID NO: 10153 - protein, 38 aa, Artificial Sequence
  Computer-generated peptide variant
KLRLWRRWIKFLQTKNLLWILELAKNKKYVFAAHLKCF

SEQ ID NO: 10154 - protein, 23 aa, Artificial Sequence
  Computer-generated peptide variant
FLKLLQKFLKFLSKRICKPRTNA

SEQ ID NO: 10155 - protein, 24 aa, Artificial Sequence
  Computer-generated peptide variant
KWKFFHRLLKLLRRAKLCRQNAMT

SEQ ID NO: 10156 - protein, 65 aa, Artificial Sequence
  Computer-generated peptide variant
MLKLLTRILRLIKRDLLKRLKCRDLWFRLMNHSRAKALYHGGAAKLFRMATRLCYARPNRHAHPF

SEQ ID NO: 10157 - protein, 20 aa, Artificial Sequence
  Computer-generated peptide variant
KIRFLKRWLKLLPPAKVATN

SEQ ID NO: 10158 - protein, 34 aa, Artificial Sequence
  Computer-generated peptide variant
IYKLMHKFYRKLHKALGFKKAIKKLYPAKRDAEL

SEQ ID NO: 10159 - protein, 31 aa, Artificial Sequence
  Computer-generated peptide variant
LLRFMKRYYRLLCTLSRERKALCKKNIRKML

SEQ ID NO: 10160 - protein, 54 aa, Artificial Sequence
  Computer-generated peptide variant
KWKLFSRLMKKFKTDKLRRARARIHLLKALYHKPLRDHMELTLKTIAYRPLADM

SEQ ID NO: 10161 - protein, 33 aa, Artificial Sequence
  Computer-generated peptide variant
KLRMIPKWLKKMRSRLLMAACAAARWDRAFNAY

SEQ ID NO: 10162 - protein, 32 aa, Artificial Sequence
  Computer-generated peptide variant
LFRLFKKLMRFLRRDGAIALIAVCARNHKRFM

SEQ ID NO: 10163 - protein, 54 aa, Artificial Sequence
  Computer-generated peptide variant
RMRFLCRLLRKLRSQYYNYAACKSASNKGLRNSSTYKYLRARKRWFARRLTAKK

SEQ ID NO: 10164 - protein, 32 aa, Artificial Sequence
  Computer-generated peptide variant
FFRFIKRLFRLLQQERPHALLPKRGAMKYLKL

SEQ ID NO: 10165 - protein, 42 aa, Artificial Sequence
  Computer-generated peptide variant
KWRMYPKLLKWLRPAAFRLLKAVLYYVLKLTKRKHKQRLLLH

SEQ ID NO: 10166 - protein, 60 aa, Artificial Sequence
  Computer-generated peptide variant
IYRFLHRYIKKLTCSLKAAKALDGMLLSEAGAKDHRALRATWLVKMQHKRWRADRRNRMK

SEQ ID NO: 10167 - protein, 41 aa, Artificial Sequence
  Computer-generated peptide variant
RWRLFTKLLRWWKRCNKYARKKDAEAFAKVKHKRGTLACAC

SEQ ID NO: 10168 - protein, 21 aa, Artificial Sequence
  Computer-generated peptide variant
RYRLLNRMLKKLKRIAIAYCN

SEQ ID NO: 10169 - protein, 31 aa, Artificial Sequence
  Computer-generated peptide variant
KLKFMQRFLKLLKPKLMAPAKGRKKLDDRLY

SEQ ID NO: 10170 - protein, 38 aa, Artificial Sequence
  Computer-generated peptide variant
RLRYLKRLLKKLNNLQATALAFKKKPSVEKTAPAKAKA

SEQ ID NO: 10171 - protein, 32 aa, Artificial Sequence
  Computer-generated peptide variant
RLKLLTKIYKRWRRAMPQAKWAKAYLYLAFIS

SEQ ID NO: 10172 - protein, 25 aa, Artificial Sequence
  Computer-generated peptide variant
LLRFLQKYLRLMNPKQMNVEKLKKA

SEQ ID NO: 10173 - protein, 94 aa, Artificial Sequence
  Computer-generated peptide variant
LLKLLKKLLRLLRRKRHWFKFLMFPARRDTVADPTWFLLKRHMNQRHQKHLARGKKDMRKMAKAYAKMKLGSHNALLAFAPFNIFKILALAHLM

SEQ ID NO: 10174 - protein, 29 aa, Artificial Sequence
  Computer-generated peptide variant
KMRLLTKFLRFLRKGALKNCAWKFEACKP

SEQ ID NO: 10175 - protein, 59 aa, Artificial Sequence
  Computer-generated peptide variant
KLKFIKKLLRLFKPHYSFAWFACKLKREASKLRAKLELQKLAFMRCTHATGHKPLQRRI

SEQ ID NO: 10176 - protein, 33 aa, Artificial Sequence
  Computer-generated peptide variant
FYRLLKRFMRFYRCKRSASNACILAKAGILRLL

SEQ ID NO: 10177 - protein, 41 aa, Artificial Sequence
  Computer-generated peptide variant
IFRLWKKYLRKLRKLRNWIAAVLIARHGSAIKRLILKKATQ

SEQ ID NO: 10178 - protein, 48 aa, Artificial Sequence
  Computer-generated peptide variant
RMKWYRRLFRWIKRLDAKKDKKRKRALYWSHCLLKPAYDLHAALKCPT

SEQ ID NO: 10179 - protein, 32 aa, Artificial Sequence
  Computer-generated peptide variant
LWRLMKRLMRFYKRNWEWKRTTLAPRDDAALK

SEQ ID NO: 10180 - protein, 28 aa, Artificial Sequence
  Computer-generated peptide variant
KYRLWKKLYKRIKRYWVANEAKLLTGLP

SEQ ID NO: 10181 - protein, 30 aa, Artificial Sequence
  Computer-generated peptide variant
KMRFLRKLLKWFTRYFSKRQVRAPLGSARL

SEQ ID NO: 10182 - protein, 60 aa, Artificial Sequence
  Computer-generated peptide variant
KFKWMPRYIRKLRKALTVPCDARLNGFRLHKKALWIFKGDLRPLALKAKRRNSVRARHFQ

SEQ ID NO: 10183 - protein, 29 aa, Artificial Sequence
  Computer-generated peptide variant
RWKLFHRMMKKWNKCRLAAGKGLLEEAPA

SEQ ID NO: 10184 - protein, 76 aa, Artificial Sequence
  Computer-generated peptide variant
RIKFFNKLMRRWRRRRQYLKRSRMKHRMALKMARFPQLCLLLANKANQAQYKMIAAKRAAMAARAYAFHNEGLMWI

SEQ ID NO: 10185 - protein, 52 aa, Artificial Sequence
  Computer-generated peptide variant
KLKWYRRWMKRLHNADLRRSLANQLISEFMVARERTLKQARLATARGYSALA

SEQ ID NO: 10186 - protein, 33 aa, Artificial Sequence
  Computer-generated peptide variant
LLKLLSKMYKKLKCAAWRLPKHKVRANFIKLPR

SEQ ID NO: 10187 - protein, 63 aa, Artificial Sequence
  Computer-generated peptide variant
FIRLWKRFLRKMPTACMGLKALVRARRKLEAFRCWQARDDVRNKLALYLKKEGQMTIKRLKFR

SEQ ID NO: 10188 - protein, 94 aa, Artificial Sequence
  Computer-generated peptide variant
RYRWIQKMFRLLKKLMKIRAYPAHADRFDKCNAPNITLRDCACARRRLRRALLVKRGQKALLLKMDLALFLALHRLAARLLKQMLLFMWDRRKF

SEQ ID NO: 10189 - protein, 35 aa, Artificial Sequence
  Computer-generated peptide variant
LFKILRRMIKRYRNSALRLFHARLNCLLPGARGRP

SEQ ID NO: 10190 - protein, 46 aa, Artificial Sequence
  Computer-generated peptide variant
RWRFYKKLLRKLQRYWLAMRRHLKANCALDNPKLAKQKAGAKRIDR

SEQ ID NO: 10191 - protein, 32 aa, Artificial Sequence
  Computer-generated peptide variant
RYKWLKRLLRIYRRKLHWHPELAKQLRTLKKL

SEQ ID NO: 10192 - protein, 67 aa, Artificial Sequence
  Computer-generated peptide variant
RWKLYNRYYRMFKKRLAMRAVVKAAKVYDKAILACQALLMCQRMPTCALELRNQLRRKAKAFAPNNR

SEQ ID NO: 10193 - protein, 45 aa, Artificial Sequence
  Computer-generated peptide variant
KIKLMKRILKFLHKCALRWMYRIAVNKAVLRRPMKYCFKLLLRQA

SEQ ID NO: 10194 - protein, 38 aa, Artificial Sequence
  Computer-generated peptide variant
YIKLWKRLLRYMKHLRAKEFPAGNRGRTKARCLQAKMQ

SEQ ID NO: 10195 - protein, 37 aa, Artificial Sequence
  Computer-generated peptide variant
LFRFLCKFYKKLRQMLLKFPAKRAIMKVVRSARGDLR

SEQ ID NO: 10196 - protein, 98 aa, Artificial Sequence
  Computer-generated peptide variant
LMKYFRRLFKRLRSRSKRYKNCCARRKTMAFPAARAKLMLKACALCILPSEKNYYHALRLKRAALSWRFLADARRTKLKYLRAKYYRRRPLFYPESRV

SEQ ID NO: 10197 - protein, 25 aa, Artificial Sequence
  Computer-generated peptide variant
LFKLLRKMIKMLPRKLDKYQQSAAG

SEQ ID NO: 10198 - protein, 41 aa, Artificial Sequence
  Computer-generated peptide variant
LMKLLTKLMKLFRKEKAKLAVTCHAKKLDFCDLKQSTLHFK

SEQ ID NO: 10199 - protein, 40 aa, Artificial Sequence
  Computer-generated peptide variant
RFRLLRRYIKRWHPHRYAADLPKAKAKIRLPDYDRATATK

SEQ ID NO: 10200 - protein, 76 aa, Artificial Sequence
  Computer-generated peptide variant
RWRIFRKLMRKLHKKRHFQKNMLYKQLCFAAFHKLAWSYRSRAMFRYYKRKAWGRLMILLAAAWYRRRMFRFLLKA

SEQ ID NO: 10201 - protein, 27 aa, Artificial Sequence
  Computer-generated peptide variant
LYRWWRKFYKWFRKQAFWQSAALRKLA

SEQ ID NO: 10202 - protein, 71 aa, Artificial Sequence
  Computer-generated peptide variant
YMKLLRRYLRRLTRVKARLWKIRKDVLVHPMRKLEISKMEKANTPLVRFLLAKWMAAYLLKNERQKRRRKH

SEQ ID NO: 10203 - protein, 54 aa, Artificial Sequence
  Computer-generated peptide variant
LFRFLTKFLKLLQQAKLLYDNRWKRKKWECLFAKAKLLTKWMPILKASTLAWRW

SEQ ID NO: 10204 - protein, 42 aa, Artificial Sequence
  Computer-generated peptide variant
KFRYYSRLLRKLRKGHKLCKKVAIMLHCLDRLSRLLKRMTPH

SEQ ID NO: 10205 - protein, 54 aa, Artificial Sequence
  Computer-generated peptide variant
FFKLFKKIMKYIKRDALFRWISAYWAALLLWLKCALYPRRKKKIVKAIEELARK

SEQ ID NO: 10206 - protein, 66 aa, Artificial Sequence
  Computer-generated peptide variant
FLRMLCKLLRKMKHMMLRKEKDLAIMMHKAIAKRNLALTEAFIRAMALELTNLGANMGRKRHALGR

SEQ ID NO: 10207 - protein, 53 aa, Artificial Sequence
  Computer-generated peptide variant
KIRWLKRWLKLFRRRNMARRHMPAGTRLKLKRRALGIDSALYCCPLARRKTGW

SEQ ID NO: 10208 - protein, 85 aa, Artificial Sequence
  Computer-generated peptide variant
LFKLLRKMMKRLQCHRKYQKYALRAKIGTRDKKLKIIKASLKNQTGQAPKECRTASMSHKNLHEIRAFRLATRRLRKALLLLYHA

SEQ ID NO: 10209 - protein, 100 aa, Artificial Sequence
  Computer-generated peptide variant
RWKLIRRLFRRLRTRKLLLFLDRNDPFCATLNGKRQFKDAKRDNALSMFTPLPWLLQMMKLDCERLRIVARKLVHVRKLKKAARKEKRPMPALYDKAWAQ

SEQ ID NO: 10210 - protein, 29 aa, Artificial Sequence
  Computer-generated peptide variant
LLRYYNRLLKRLRKLQFENALGQHRDRLK

SEQ ID NO: 10211 - protein, 48 aa, Artificial Sequence
  Computer-generated peptide variant
RFKLLKRWWKLFCSVCRKRMKVSAKYRTDLACDALLKRPWNILKRLMA

SEQ ID NO: 10212 - protein, 60 aa, Artificial Sequence
  Computer-generated peptide variant
RLKLLKRFLKMWKTHCWAWQLFRMKFKTAMSLKRTAAGKAACRHNYTSAFAKLQMLEAAK

SEQ ID NO: 10213 - protein, 26 aa, Artificial Sequence
  Computer-generated peptide variant
IFRLLKRLLRRLKHCAGVKIKPANWF

SEQ ID NO: 10214 - protein, 56 aa, Artificial Sequence
  Computer-generated peptide variant
LFRLMTRLFRWFRRAHAEQKQRAALGMKKLKLKACACMKAIRGSRKAPGCSQLLRT

SEQ ID NO: 10215 - protein, 40 aa, Artificial Sequence
  Computer-generated peptide variant
KLKLMTKIMKLFRKLKRNSYKLAAKLAKCHEATLWLKWAY

SEQ ID NO: 10216 - protein, 54 aa, Artificial Sequence
  Computer-generated peptide variant
KWKYLHKLLKLLRSPALRNRKLILRQNLTRYYHRQWRPDIRAKAKQAWFTPAAK

SEQ ID NO: 10217 - protein, 45 aa, Artificial Sequence
  Computer-generated peptide variant
WFRIFKKLLKRMRRLLLVSYEACAKQRFNLVAPIRYQTFLRRKAR

SEQ ID NO: 10218 - protein, 74 aa, Artificial Sequence
  Computer-generated peptide variant
RMRMYSRFLKRWQCQKALLLGARCYTQKSALCRKYLQNKQQLKAEQALKQRARALHWRWRRAKTHWDVRFRKLK

SEQ ID NO: 10219 - protein, 29 aa, Artificial Sequence
  Computer-generated peptide variant
RIRMWQKLLRRFQTYPFLLLSALPAKNRA

SEQ ID NO: 10220 - protein, 35 aa, Artificial Sequence
  Computer-generated peptide variant
WWKLLSRILKLMRRKQSAHKMALAKKYRTPRLRDI

SEQ ID NO: 10221 - protein, 25 aa, Artificial Sequence
  Computer-generated peptide variant
RYRLLKKLYRRYHKALFDVLLSMDK

SEQ ID NO: 10222 - protein, 40 aa, Artificial Sequence
  Computer-generated peptide variant
KFRLYHRLIRRYKRREALALRLELHFFHRFRTSAMSPAWA

SEQ ID NO: 10223 - protein, 34 aa, Artificial Sequence
  Computer-generated peptide variant
KWRLIRRMMRRLTSKAARAVLPMLSPQEKPKKYL

SEQ ID NO: 10224 - protein, 33 aa, Artificial Sequence
  Computer-generated peptide variant
RIKFFRKLFRLFKNKARTRIRARAACAPMCLLL

SEQ ID NO: 10225 - protein, 32 aa, Artificial Sequence
  Computer-generated peptide variant
RLRMLHRFFRRFSSMLLAEFGRRKAKGATHRA

SEQ ID NO: 10226 - protein, 81 aa, Artificial Sequence
  Computer-generated peptide variant
KIRFIHKYIKYWKRRRDHRFAAAAKKLRAGRHKLLLFRLNQATEHARCFQRLQKRLIYLKKLLRDTCKHRKAGILAKAAKM

SEQ ID NO: 10227 - protein, 41 aa, Artificial Sequence
  Computer-generated peptide variant
MLKYFNKLIRRWRKMPKLSAAAALVEKERIAMFRLIDAKKT

SEQ ID NO: 10228 - protein, 35 aa, Artificial Sequence
  Computer-generated peptide variant
LYRYYCRLLRLLKTEKNLYAQLGGLVKFKKNARWA

SEQ ID NO: 10229 - protein, 34 aa, Artificial Sequence
  Computer-generated peptide variant
FYRLYTKFFKRLKRSRHILARKALKAATWQHHRC

SEQ ID NO: 10230 - protein, 46 aa, Artificial Sequence
  Computer-generated peptide variant
FLKLLRRIYRRFNRRWDKEAHAMNLPKFLQLFRLQPKRLARVARGS

SEQ ID NO: 10231 - protein, 85 aa, Artificial Sequence
  Computer-generated peptide variant
FYRLMKKILKRLRKLAIAFLRRAMPRLVAGRPRLLWRALAPLSRHLKRQCRQLIAPKANLFEIRYTSLEALTLKAKPLLHTMKLI

SEQ ID NO: 10232 - protein, 36 aa, Artificial Sequence
  Computer-generated peptide variant
IFRLLQRLMRLMPKAATRDFRERRYAALAHFAYKPE

SEQ ID NO: 10233 - protein, 82 aa, Artificial Sequence
  Computer-generated peptide variant
RFKLLRRIIKRLRKQIKEAKLKDELRMRLLACLLIRARPLVFRRKAKANMPGYGQPAKIMGLKTTDDDACDLKAKMQDLLSK

SEQ ID NO: 10234 - protein, 35 aa, Artificial Sequence
  Computer-generated peptide variant
LLRLMCKMLRKIRQRRKWIAFKATKALPLLAHLLT

SEQ ID NO: 10235 - protein, 75 aa, Artificial Sequence
  Computer-generated peptide variant
YLKFLKKLYRYFRKAICGLKFIALKEVVLANALKRRRLCWKAKYWTLLPYKERWRARATYWYYLLRAVNGAQAMR

SEQ ID NO: 10236 - protein, 50 aa, Artificial Sequence
  Computer-generated peptide variant
RFKIFRKMLRLFRRYKTLELKCAERIKYADRAKCKCVRACLAQLEAFMCL

SEQ ID NO: 10237 - protein, 54 aa, Artificial Sequence
  Computer-generated peptide variant
MIKWLRRWFKKLRCAHYLYAATRKLHAWRRLKKMAMLELKASKARSWLRDSAWM

SEQ ID NO: 10238 - protein, 20 aa, Artificial Sequence
  Computer-generated peptide variant
KLRLFHKIIKLLQPLERAKS

SEQ ID NO: 10239 - protein, 29 aa, Artificial Sequence
  Computer-generated peptide variant
RWRMLHRFIRFLRHAVWDYLALAAKAKTH

SEQ ID NO: 10240 - protein, 37 aa, Artificial Sequence
  Computer-generated peptide variant
KLKWWRKWIKLFRRRHPAPWADKAWLAFQLLRLMREV

SEQ ID NO: 10241 - protein, 56 aa, Artificial Sequence
  Computer-generated peptide variant
RWRLLKRLLRYFCRAWGATMRTKADKFRLKGALSNKRSRKNALMNAAMLFKLYKDP

SEQ ID NO: 10242 - protein, 33 aa, Artificial Sequence
  Computer-generated peptide variant
FFKYLKKLYKRFKKPLGAPRRLSNNPRLLATRL

The invention claimed is:

1. A protein transduction composition comprising a shuttle agent and a polypeptide cargo to be delivered intracellularly to mammalian target cells, wherein the shuttle agent is:
(1) a peptide soluble in aqueous solution having an overall length of between 20 and 150 amino acids comprising
(2) an amphipathic alpha-helical motif having
(3) a positively-charged hydrophilic outer face comprising: (a) at least two adjacent positively-charged K and/or R residues upon helical wheel projection; and/or (b) a segment of six adjacent residues comprising three to five K and/or R residues upon helical wheel projection, based on an alpha helix having angle of rotation between consecutive amino acids of 100 degrees and/or an alpha-helix having 3.6 residues per turn; and
(4) a hydrophobic outer face comprising a highly hydrophobic core consisting of spatially adjacent L, I, F, V, W, and/or M amino acids representing 12 to 50% of the amino acids of the peptide, based on an open cylindrical representation of the alpha-helix having 3.6 residues per turn;
wherein at least six of the following parameters (5) to (15) are respected:
(5) the peptide has a hydrophobic moment (μ) of 3.5 to 11;
(6) the peptide has a predicted net charge of at least +4 at physiological pH, calculated from amino acid residues having charged side chains;
(7) the peptide has an isoelectric point (pI) of 8 to 13;
(8) the peptide is composed of 35% to 65% of any combination of the amino acids: A, C, G, I, L, M, F, P, W, Y, and V;
(9) the peptide is composed of 0% to 30% of any combination of the amino acids: N, Q, S, and T;
(10) the peptide is composed of 35% to 85% of any combination of the amino acids: A, L, K, or R;
(11) the peptide is composed of 15% to 45% of any combination of the amino acids: A and L, provided there being at least 5% of L in the peptide;
(12) the peptide is composed of 20% to 45% of any combination of the amino acids: K and R;
(13) the peptide is composed of 0% to 10% of any combination of the amino acids: D and E;
(14) the difference between the percentage of A and L residues in the peptide (% A+L), and the percentage of K and R residues in the peptide (% K+R), is less than or equal to 10%; and
(15) the peptide is composed of 10% to 45% of any combination of the amino acids: Q, Y, W, P, I, S, G, V, F, E, D, C, M, N, T and H,
wherein the concentration of the shuttle agent in said composition is at least 2.5 μM and is sufficient to increase transduction efficiency and cytosolic delivery of the polypeptide cargo, as compared to in the absence of the shuttle agent, upon contact of the composition with target eukaryotic cells,
wherein the shuttle agent and the polypeptide cargo comprise independent polypeptide backbones or are not covalently bound, and
wherein both the shuttle agent and the polypeptide cargo lack a cell penetrating domain.

2. The protein transduction composition of claim 1, wherein:
(i) said shuttle agent is a peptide having a minimum length of 21, 22, 23, 24, 25, 26, 27, 28, 29, or 30 amino acids, and a maximum length of 40, 41, 42, 43, 44, 45, 46, 47, 48, 49, 50, 51, 52, 53, 54, 55, 60, 65, 70, 80, 90, 100, 110, 120, 130, or 140 amino acids;
(ii) said amphipathic alpha-helical motif has a hydrophobic moment (μ) between a lower limit of 3.5, 3.6, 3.7, 3.8, 3.9, 4.0, 4.1, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, 6.5, 6.6, 6.7, 6.8, 6.9, or 7.0, and an upper limit of 9.5, 9.6, 9.7, 9.8, 9.9, 10.0, 10.1, 10.2, 10.3, 10.4, 10.5, 10.6, 10.7, 10.8, 10.9, or 11.0;
(iii) said amphipathic alpha-helical motif comprises a positively-charged hydrophilic outer face comprising: (a) at least three or four adjacent positively-charged K and/or R residues upon helical wheel projection;
(iv) said amphipathic alpha-helical motif comprises a hydrophobic outer face comprising: (a) at least two adjacent L residues upon helical wheel projection; and/or (b) a segment of ten adjacent residues comprising at least five hydrophobic residues selected from: L, I, F, V, W, and M, upon helical wheel projection, based on an alpha helix having angle of rotation between consecutive amino acids of 100 degrees and/or an alpha-helix having 3.6 residues per turn;
(v) said hydrophobic outer face comprises a highly hydrophobic core consisting of spatially adjacent L, I, F, V, W, and/or M amino acids representing from 12.5%, 13%, 13.5%, 14%, 14.5%, 15%, 15.5%, 16%, 16.5%, 17%, 17.5%, 18%, 18.5%, 19%, 19.5%, or 20%, to 25%, 30%, 35%, 40%, or 45% of the amino acids of the peptide;
(vi) said peptide has a hydrophobic moment (μ) between a lower limit of 4.0, 4.1, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, 6.5, 6.6, 6.7, 6.8, 6.9, or 7.0, and an upper limit of 9.5, 9.6, 9.7, 9.8, 9.9, 10.0, 10.1, 10.2, 10.3, 10.4, or 10.5;
(vii) said peptide has a predicted net charge of from +4, +5, +6, +7, +8, or +9, to +10, +11, +12, +13, +14, or +15, calculated from amino acid residues having charged side chains;
(viii) said peptide has a predicted pI of 10-13; or
(ix) any combination of (i) to (viii).

3. The protein transduction composition of claim 1, wherein said shuttle agent respects at least one, at least two, at least three, at least four, at least five, at least six, or all of the following parameters:
   (1) the peptide is composed of from 36% to 64%, 37% to 63%, 38% to 62%, 39% to 61%, or 40% to 60% of any combination of the amino acids: A, C, G, I, L, M, F, P, W, Y, and V;
   (2) the peptide is composed of from 1% to 29%, 2% to 28%, 3% to 27%, 4% to 26%, 5% to 25%, 6% to 24%, 7% to 23%, 8% to 22%, 9% to 21%, or 10% to 20% of any combination of the amino acids: N, Q, S, and T;
   (3) the peptide is composed of from 36% to 80%, 37% to 75%, 38% to 70%, 39% to 65%, or 40% to 60% of any combination of the amino acids: A, L, K, or R;
   (4) the peptide is composed of 15% to 40%, 20% to 40%, 20 to 35%, or 20 to 30% of any combination of the amino acids: A and L;
   (5) the peptide is composed of 20% to 40%, 20 to 35%, or 20 to 30% of any combination of the amino acids: K and R;
   (6) the peptide is composed of 5 to 10% of any combination of the amino acids: D and E;
   (7) the difference between the percentage of A and L residues in the peptide (% A+L), and the percentage of K and R residues in the peptide (% K+R), is less than or equal to 9%, 8%, 7%, 6%, or 5%; and
   (8) the peptide is composed of 15% to 40%, 20% to 35%, or 20% to 30% of any combination of the amino acids: Q, Y, W, P, I, S, G, V, F, E, D, C, M, N, T, and H.

4. The protein transduction composition of claim 1, wherein said shuttle agent further comprises a histidine-rich domain positioned towards the N terminus and/or towards the C terminus of the shuttle agent, wherein said histidine-rich domain is a stretch of at least 3, at least 4, at least 5, or at least 6 amino acids comprising at least 50%, at least 55%, at least 60%, at least 65%, at least 70%, at least 75%, at least 80%, at least 85%, or at least 90% histidine residues; and/or comprises at least 2, at least 3, at least 4, at least 5, at least 6, at least 7, at least 8, or at least 9 consecutive histidine residues.

5. The protein transduction composition of claim 1, wherein said shuttle agent further comprises a flexible linker domain rich in serine and/or glycine residues.

6. The protein transduction composition of claim 1, wherein said shuttle agent comprises or consists of the amino acid sequence of:

(a) [X1]-[X2]-[linker]-[X3]-[X4]     (Formula 1);
   (b) [X1]-[X2]-[linker]-[X4]-[X3]     (Formula 2);
   (c) [X2]-[X1]-[linker]-[X3]-[X4]     (Formula 3);
   (d) [X2]-[X1]-[linker]-[X4]-[X3]     (Formula 4);
   (e) [X3]-[X4]-[linker]-[X1]-[X2]     (Formula 5);
   (f) [X3]-[X4]-[linker]-[X2]-[X1]     (Formula 6);
   (g) [X4]-[X3]-[linker]-[X1]-[X2]     (Formula 7); or
   (h) [X4]-[X3]-[linker]-[X2]-[X1]     (Formula 8), wherein:
[X1] is selected from: 2[Φ]-1[+]-2[Φ]-1[ζ]-1[+]-; 2[Φ]-1[+]-2[Φ]-2[+]-; 1[+]-1[Φ]-1[+]-2[Φ]-1[ζ]-1[+]-; and 1[+]-1[Φ]-1[+]-2[Φ]-2[+]-;

[X2] is selected from: -2[Φ]-1[+]-2[101]-2[ζ]-; -2[Φ]-1[+]-2[Φ]-2[+]-; -2[Φ]-1[+]-2[Φ]-1[+]-1[ζ]-; -2[Φ]-1[+]-2[Φ]-1[ζ]-1[+]-; -2[Φ]-2[+]-1[Φ]-2[+]-; -2[Φ]-2[+]-1[Φ]-2[ζ]-; -2[Φ]-2[+]-1[Φ]-1[+]-1[ζ]-; and -2[Φ]-2[+]-1[Φ]-1[ζ]-1[+]-;

[X3] is selected from: -4[+]-A-; -3[+]-G-A-; -3[+]-A-A-; -2[+]-1[Φ]-1[+]-A-; -2[+]-1[Φ]-G-A-; -2[+]-1[Φ]-A-A-; or -2[+]-A-1[+]-A; -2[+]-A-G-A; -2[+]-A-A-A-; -1[Φ]-3[+]-A-; -1[Φ]-2[+]-G-A-; -1[Φ]-2[+]-A-A-; -1[Φ]-1[+]-1[Φ]-1[+]-A; -1[Φ]-1[+]-1[Φ]-G-A; -1[Φ]-1[+]-1[Φ]-A-A; -1[Φ]-1[+]-A-1[+]-A; -1[Φ]-1[+]-A-G-A; -1[Φ]-1[+]-A-A-A; -A-1[+]-A-1[+]-A; -A-1[+]-A-G-A; and -A-1[+]-A-A-A;

[X4] is selected from: -1[ζ]-2A-1[+]-A; -1[ζ]-2A-2[+]; -1[+]-2A-1[+]-A; -1[ζ]-2A-1[+]-1[ζ]-A-1[+]; -1[ζ]-A-1[ζ]-A-1[+]; -2[+]-A-2[+]; -2[+]-A-1[+]-A; -2[+]-A-1[+]-1[ζ]-A-1[+]; -2[+]-1[ζ]-A-1[+]; -1[+]-1[ζ]-A-1[+]-A; -1[+]-1[ζ]-A-2[+]; -1[+]-1[ζ]-A-1[+]-1[ζ]-A-1[+]; 1[+]-2[ζ]-A-1[+]; -1[+]-2[ζ]-2[+]; -1[+]-2[ζ]-1[+]-A; -1[+]-2[ζ]-1[+]-1[ζ]-A-1[+]; -1[+]-2[ζ]-1[+]-A-1[+]; 3[ζ]-2[+]; -3[ζ]-1[+]-A; -3[ζ]-1[+]-1[ζ]-A-1[+]; -1[ζ]-2A-1[+]-A; -1[ζ]-2A-2[+]; -1[ζ]-2A-1[+]-1[ζ]-A-1[+]; -2[+]-A-1[+]-A; -2[+]-1[ζ]-1[+]-A; -1[+]-1[ζ]-A-1[+]-A; -1[+]-2A-1[+]-1[ζ]-A-1[+]; and -1[ζ]-A-1[ζ]-A-1[+]; and

[linker] is selected from: -Gn-; -Sn-; -(GnSn)n-; -(GnSn)nGn-; -(GnSn)nSn-; -(GnSn)nGn(GnSn)n-; and (GnSn)nSn(GnSn)n-;

wherein:
[Φ] is an amino acid which is: Leu, Phe, Trp, Ile, Met, Tyr, or Val;
[+] is an amino acid which is: Lys or Arg;
[ζ] is an amino acid which is: Gln, Asn, Thr, or Ser;
A is the amino acid Ala;
G is the amino acid Gly;
S is the amino acid Ser; and
n is an integer from 1 to 20, 1 to 19, 1 to 18, 1 to 17, 1 to 16, 1 to 15, 1 to 14, 1 to 13, 1 to 12, 1 to 11, 1 to 10, 1 to 9, 1 to 8, 1 to 7, 1 to 6, 1 to 5, 1 to 4, or 1 to 3.

7. The protein transduction composition of claim 1, wherein said polypeptide cargo comprises a subcellular targeting domain which is:
   (a) a nuclear localization signal (NLS);
   (b) a nucleolar signal sequence;
   (c) a mitochondrial signal sequence; or
   (d) a peroxisome signal sequence.

8. The protein transduction composition of claim 1, wherein said polypeptide cargo is complexed with a DNA and/or RNA molecule.

9. The protein transduction composition of claim 1, wherein said polypeptide cargo is a transcription factor, a nuclease, a cytokine, a hormone, a growth factor, an antibody, a peptide cargo, an enzyme, an enzyme inhibitor, or any combination thereof.

10. The protein transduction composition of claim 9, wherein:
   (a) said transcription factor is: HOXB4, NUP98-HOXA9, Oct3/4, Sox2, Sox9, Klf4, c-Myc, MyoD, Pdx1, Ngn3, MafA, Blimp-1, Eomes, T-bet, FOXO3A, NF-YA, SALL4, ISL1, FoxA1, Nanog, Esrrb, Lin28, HIF1-alpha, Hlf, Runx1t1, Pbx1, Lmo2, Zfp37, Prdm5, Bcl-6, or any combination thereof;
   (b) said nuclease is a catalytically active or catalytically dead: RNA-guided endonuclease, CRISPR endonuclease, type I CRISPR endonuclease, type II CRISPR endonuclease, type III CRISPR endonuclease, type IV CRISPR endonuclease, type V CRISPR endonuclease, type VI CRISPR endonuclease, CRISPR associated protein 9 (Cas9), Cpf1, CasY, CasX, zinc-finger nuclease (ZFNs), Transcription activator-like effector nucleases (TALENs), homing endonuclease, meganuclease, DNA-guided nuclease, *Natronobacterium gregoryi* Argonaute (NgAgo), or any combination thereof;

(c) said antibody recognizes an intracellular antigen; and/or (d) said peptide cargo recognizes an intracellular molecule.

11. The protein transduction composition of claim 1, wherein said hydrophobic outer face comprises a highly hydrophobic core consisting of spatially adjacent L, I, F, V, W, and/or M amino acids representing from 12% to 45% of the amino acids of the peptide.

12. The protein transduction composition of claim 1, wherein said hydrophobic outer face comprises a highly hydrophobic core consisting of spatially adjacent L, I, F, V, W, and/or M amino acids representing from 12% to 40% of the amino acids of the peptide.

13. The protein transduction composition of claim 1, wherein the shuttle agent is a peptide having an overall length of between 25 and 150 amino acids.

14. The protein transduction composition of claim 1, wherein the shuttle agent is a peptide having an isoelectric point (pI) of 8 to 13.

15. The protein transduction composition of claim 1, wherein the concentration of the shuttle agent in said composition is at least 5 μM.

16. The protein transduction composition of claim 1, wherein the concentration of the shuttle agent in said composition is at least 10 μM.

17. The protein transduction composition of claim 1, wherein the concentration of the shuttle agent in said composition is at least 20 μM.

* * * * *